United States Patent
Ronen et al.

(10) Patent No.: US 8,686,227 B2
(45) Date of Patent: Apr. 1, 2014

(54) POLYNUCLEOTIDES, POLYPEPTIDES ENCODED THEREBY, AND METHODS OF USING SAME FOR INCREASING ABIOTIC STRESS TOLERANCE AND/OR BIOMASS AND/OR YIELD IN PLANTS EXPRESSING SAME

(75) Inventors: Gil Ronen, Emek Hefer (IL); Hagai Karchi, Moshav Sitriya Doar-Na Emek Soreq (IL); Alex Diber, Rishon-LeZion (IL); Basia Judith Vinocur, Rechovot (IL); Sharon Ayal, Kiryat-Ekron (IL); Eyal Emmanuel, Rechovot (IL); Michael Gang, Vienna (AU); Dotan Dimet, Tel-Aviv (IL)

(73) Assignee: Evogene Ltd., Rechovot (IL)

( * ) Notice: Subject to any disclaimer, the term of this patent is extended or adjusted under 35 U.S.C. 154(b) by 0 days.

(21) Appl. No.: 12/669,975

(22) PCT Filed: Jul. 24, 2008

(86) PCT No.: PCT/IL2008/001024
§ 371 (c)(1),
(2), (4) Date: Jul. 21, 2010

(87) PCT Pub. No.: WO2009/013750
PCT Pub. Date: Jan. 29, 2009

(65) Prior Publication Data
US 2010/0319088 A1   Dec. 16, 2010

Related U.S. Application Data

(60) Provisional application No. 60/935,046, filed on Jul. 24, 2007.

(51) Int. Cl.
*A01H 5/00* (2006.01)
*C12N 15/29* (2006.01)
*C12N 15/82* (2006.01)

(52) U.S. Cl.
USPC .......... 800/290; 800/289; 800/298; 435/69.1; 435/91.1; 435/468; 435/419

(58) Field of Classification Search
None
See application file for complete search history.

(56) References Cited

U.S. PATENT DOCUMENTS

| | | | |
|---|---|---|---|
| 3,791,932 A | 2/1974 | Schuurs et al. |
| 3,839,153 A | 10/1974 | Schuurs et al. |
| 3,850,578 A | 11/1974 | McConnell |
| 3,850,752 A | 11/1974 | Schuurs et al. |
| 3,853,987 A | 12/1974 | Dreyer |
| 3,867,517 A | 2/1975 | Ling |
| 3,879,262 A | 4/1975 | Schuurs et al. |
| 3,901,654 A | 8/1975 | Gross |
| 3,935,074 A | 1/1976 | Rubenstein et al. |
| 3,984,533 A | 10/1976 | Uzgiris |
| 3,996,345 A | 12/1976 | Ullman et al. |
| 4,034,074 A | 7/1977 | Miles |
| 4,098,876 A | 7/1978 | Piasio et al. |
| 4,666,828 A | 5/1987 | Gusella |
| 4,683,202 A | 7/1987 | Mullis |
| 4,801,531 A | 1/1989 | Frossard |
| 4,879,219 A | 11/1989 | Wands et al. |
| 4,943,674 A | 7/1990 | Houck et al. |
| 4,945,050 A | 7/1990 | Sanford et al. |
| 5,011,771 A | 4/1991 | Bellet et al. |
| 5,187,267 A | 2/1993 | Comai et al. |
| 5,192,659 A | 3/1993 | Simons |
| 5,268,463 A | 12/1993 | Jefferson |
| 5,272,057 A | 12/1993 | Smulson et al. |
| 5,281,521 A | 1/1994 | Trojanowski et al. |
| 5,296,462 A | 3/1994 | Thomashow |
| 5,316,931 A | 5/1994 | Donson et al. |
| 5,356,816 A | 10/1994 | Thomashow |
| 5,399,680 A | 3/1995 | Zhu et al. |
| 5,464,765 A | 11/1995 | Coffee et al. |
| 5,466,785 A | 11/1995 | De Framond |
| 5,495,070 A | 2/1996 | John |
| 5,504,200 A | 4/1996 | Hall et al. |
| 5,521,708 A | 5/1996 | Beretta |
| 5,569,597 A | 10/1996 | Grimsley et al. |
| 5,597,718 A | 1/1997 | John et al. |

(Continued)

FOREIGN PATENT DOCUMENTS

| | | |
|---|---|---|
| AU | 2005229157 | 10/2005 |
| AU | 2005234725 | 12/2005 |

(Continued)

OTHER PUBLICATIONS

Davletona (Plant Physiology, Oct. 2005, vol. 139, pp. 847-856-.*

(Continued)

*Primary Examiner* — Brent T Page
*Assistant Examiner* — Lee A Visone

(57) ABSTRACT

Provided are methods of increasing tolerance of a plant to abiotic stress, and/or increasing biomass, growth rate, vigor and/or yield of a plant. The methods are effected by expressing within the plant an exogenous polynucleotide encoding a polypeptide comprising an amino acid sequence at least 90% homologous to the amino acid sequence selected from the group consisting of SEQ ID NOs:201, 207, 212, 202-206, 208-211, 213-391, 1655, 961-1529, and 1660-1663. Also provided are polynucleotides, nucleic acid constructs, polypeptides and transgenic plants expressing same which can be used to increase tolerance of a plant to abiotic stress, and/or increase biomass, growth rate, vigor and/or yield of a plant.

17 Claims, 2 Drawing Sheets
(2 of 2 Drawing Sheet(s) Filed in Color)

(56) References Cited

U.S. PATENT DOCUMENTS

| | | |
|---|---|---|
| 5,604,121 A | 2/1997 | Hilder et al. |
| 5,608,142 A | 3/1997 | Barton et al. |
| 5,608,144 A | 3/1997 | Baden et al. |
| 5,608,149 A | 3/1997 | Barry et al. |
| 5,608,152 A | 3/1997 | Kridl et al. |
| 5,620,882 A | 4/1997 | John |
| 5,659,026 A | 8/1997 | Baszczynski et al. |
| 5,693,507 A | 12/1997 | Daniell et al. |
| 5,859,330 A | 1/1999 | Bestwick et al. |
| 5,880,100 A | 3/1999 | Ogiso et al. |
| 5,961,466 A | 10/1999 | Anbar |
| 5,981,834 A | 11/1999 | John et al. |
| 6,080,914 A | 6/2000 | Conner |
| 6,084,153 A | 7/2000 | Good et al. |
| 6,094,198 A | 7/2000 | Shashua |
| 6,167,151 A | 12/2000 | Albeck et al. |
| 6,201,541 B1 | 3/2001 | Shalom et al. |
| 6,313,375 B1 | 11/2001 | Jung et al. |
| 6,313,376 B1 | 11/2001 | Jung et al. |
| 6,359,196 B1 | 3/2002 | Lok et al. |
| 6,392,122 B1 | 5/2002 | Clendennen et al. |
| 6,403,862 B1 | 6/2002 | Jiao et al. |
| 6,442,419 B1 | 8/2002 | Chu et al. |
| 6,472,588 B1 | 10/2002 | Haigler et al. |
| 6,670,528 B1 | 12/2003 | Shinozaki et al. |
| 6,701,081 B1 | 3/2004 | Dwyer et al. |
| 6,720,477 B2 | 4/2004 | Da Costa e Silva et al. |
| 6,765,607 B2 | 7/2004 | Hirama et al. |
| 6,801,257 B2 | 10/2004 | Segev et al. |
| 6,850,862 B1 | 2/2005 | Chidichimo et al. |
| 6,965,690 B2 | 11/2005 | Matsumoto |
| 7,072,504 B2 | 7/2006 | Miyano et al. |
| 7,214,786 B2 | 5/2007 | Kovalic et al. |
| 7,292,719 B2 | 11/2007 | Arnon |
| 7,554,007 B2 | 6/2009 | Ronen et al. |
| 7,812,218 B2 | 10/2010 | Ronen et al. |
| 7,910,800 B2 | 3/2011 | Karchi et al. |
| 8,049,069 B2 | 11/2011 | Wu et al. |
| 8,168,857 B2 | 5/2012 | Ayal et al. |
| 8,426,682 B2 | 4/2013 | Ronen et al. |
| 2001/0046316 A1 | 11/2001 | Miyano et al. |
| 2002/0046419 A1 | 4/2002 | Choo et al. |
| 2002/0049999 A1 | 4/2002 | Allen et al. |
| 2002/0148007 A1 | 10/2002 | Jiao et al. |
| 2002/0160378 A1 | 10/2002 | Harper et al. |
| 2002/0170088 A1 | 11/2002 | Wilkins |
| 2003/0005485 A1 | 1/2003 | Ohlrogge et al. |
| 2003/0074697 A1 | 4/2003 | Allen et al. |
| 2003/0084485 A1 | 5/2003 | Zhu et al. |
| 2003/0162294 A1 | 8/2003 | Verbruggen |
| 2003/0163839 A1 | 8/2003 | Helentjaris et al. |
| 2003/0233670 A1 | 12/2003 | Edgerton et al. |
| 2004/0006794 A1 | 1/2004 | Wilkins |
| 2004/0019927 A1 | 1/2004 | Sherman et al. |
| 2004/0031072 A1 | 2/2004 | La Rosa et al. |
| 2004/0034888 A1 | 2/2004 | Liu et al. |
| 2004/0123343 A1* | 6/2004 | La Rosa et al. ............ 800/278 |
| 2004/0172684 A1 | 9/2004 | Kovalic et al. |
| 2004/0181830 A1 | 9/2004 | Kovalic et al. |
| 2004/0236225 A1 | 11/2004 | Murphy et al. |
| 2005/0096515 A1 | 5/2005 | Geng |
| 2005/0108791 A1 | 5/2005 | Edgerton |
| 2006/0048240 A1 | 3/2006 | Alexandrov et al. |
| 2006/0101543 A1 | 5/2006 | Somerville et al. |
| 2006/0107345 A1 | 5/2006 | Alexandrov et al. |
| 2006/0123505 A1 | 6/2006 | Kikuchi et al. |
| 2006/0123516 A1 | 6/2006 | Ronen et al. |
| 2006/0137043 A1 | 6/2006 | Puzio et al. |
| 2006/0143729 A1 | 6/2006 | Alexandrov et al. |
| 2006/0150283 A1 | 7/2006 | Alexandrov et al. |
| 2006/0168684 A1 | 7/2006 | Renz et al. |
| 2006/0174373 A1 | 8/2006 | Gipmans et al. |
| 2006/0179511 A1 | 8/2006 | Chomet et al. |
| 2006/0183137 A1 | 8/2006 | Harper et al. |
| 2006/0195943 A1 | 8/2006 | Feldmann et al. |
| 2006/0206961 A1 | 9/2006 | Cirpus et al. |
| 2006/0260002 A1 | 11/2006 | Ronen et al. |
| 2006/0288451 A1 | 12/2006 | Val et al. |
| 2007/0006345 A1 | 1/2007 | Alexandrov et al. |
| 2007/0006346 A1 | 1/2007 | Alexandrov et al. |
| 2007/0044171 A1 | 2/2007 | Kovalic et al. |
| 2007/0044172 A1 | 2/2007 | Schneeberger et al. |
| 2007/0061916 A1 | 3/2007 | Kovalic et al. |
| 2007/0124833 A1 | 5/2007 | Abad et al. |
| 2007/0169219 A1 | 7/2007 | Nadzan et al. |
| 2007/0214517 A1 | 9/2007 | Alexandrov et al. |
| 2007/0261130 A1 | 11/2007 | Lightner et al. |
| 2008/0072340 A1 | 3/2008 | Troukhan et al. |
| 2008/0076179 A1 | 3/2008 | Hartel et al. |
| 2008/0148432 A1 | 6/2008 | Abad |
| 2008/0197120 A1 | 8/2008 | Beck et al. |
| 2008/0301839 A1 | 12/2008 | Ravanello |
| 2009/0089898 A1 | 4/2009 | Karchi et al. |
| 2009/0093620 A1 | 4/2009 | Kovalic et al. |
| 2009/0094717 A1 | 4/2009 | Troukhan et al. |
| 2009/0126042 A1 | 5/2009 | Ronen et al. |
| 2009/0260109 A1 | 10/2009 | Ronen et al. |
| 2009/0293154 A1 | 11/2009 | Yelin et al. |
| 2010/0037352 A1 | 2/2010 | Alexandrov et al. |
| 2010/0154077 A1 | 6/2010 | Emmanuel et al. |
| 2011/0080674 A1 | 4/2011 | Durand |
| 2011/0214206 A1 | 9/2011 | La Rosa et al. |
| 2012/0060234 A1 | 3/2012 | Emmanuel et al. |
| 2012/0084885 A1 | 4/2012 | Alexandrov et al. |
| 2012/0096587 A1 | 4/2012 | Vinocur et al. |
| 2012/0180164 A1 | 7/2012 | Ayal et al. |
| 2012/0222169 A1 | 8/2012 | Ronen et al. |
| 2012/0297504 A1 | 11/2012 | Granevitze et al. |
| 2013/0125258 A1 | 5/2013 | Emmanuel et al. |
| 2013/0167265 A1 | 6/2013 | Panik et al. |
| 2013/0219562 A1 | 8/2013 | Ronen et al. |
| 2013/0239255 A1 | 9/2013 | Ronen et al. |
| 2013/0276169 A1 | 10/2013 | Poraty et al. |
| 2013/0291223 A1 | 10/2013 | Emmanuel et al. |

FOREIGN PATENT DOCUMENTS

| | | |
|---|---|---|
| CN | 1823168 | 8/2006 |
| DE | 10150918 | 5/2003 |
| EP | 0834566 | 4/1998 |
| EP | 0905242 | 3/1999 |
| EP | 1033405 | 9/2000 |
| EP | 1225231 | 7/2002 |
| EP | 1945021 | 7/2008 |
| EP | 2154946 | 2/2010 |
| GB | 2358752 | 8/2001 |
| JP | 2005-052114 | 3/2005 |
| JP | 2005-185101 | 7/2005 |
| RU | 2350653 | 3/2009 |
| WO | WO 93/06710 | 4/1993 |
| WO | WO 93/07278 | 4/1993 |
| WO | WO 94/17194 | 8/1994 |
| WO | WO 95/08914 | 4/1995 |
| WO | WO 96/26639 | 9/1996 |
| WO | WO 96/40924 | 12/1996 |
| WO | WO 01/17333 | 3/2001 |
| WO | WO 01/40250 | 6/2001 |
| WO | WO 02/16655 | 2/2002 |
| WO | WO 02/45485 | 6/2002 |
| WO | WO 02/079403 | 10/2002 |
| WO | WO 02/090557 | 11/2002 |
| WO | WO 03/020025 | 3/2003 |
| WO | WO 03/087313 | 10/2003 |
| WO | WO 03/098186 | 11/2003 |
| WO | WO 2004/035798 | 4/2004 |
| WO | WO 2004/053055 | 6/2004 |
| WO | WO 2004/058963 | 7/2004 |
| WO | WO 2004/081173 | 9/2004 |
| WO | WO 2004/092367 | 10/2004 |
| WO | WO 2004/104162 | 12/2004 |
| WO | WO 2004/111183 | 12/2004 |
| WO | WO 2005/084331 | 9/2005 |
| WO | WO 2005/095614 | 10/2005 |
| WO | WO 2005/108422 | 11/2005 |

(56) References Cited

FOREIGN PATENT DOCUMENTS

| WO | WO 2005/121364 | 12/2005 |
|---|---|---|
| WO | WO 2006/003658 | 1/2006 |
| WO | WO 2006/138012 | 12/2006 |
| WO | WO 2007/020638 | 2/2007 |
| WO | WO 2007/049275 | 5/2007 |
| WO | WO 2007/110314 | 10/2007 |
| WO | WO 2007/113237 | 10/2007 |
| WO | WO 2008/069878 | 6/2008 |
| WO | WO 2008/075364 | 6/2008 |
| WO | WO 2008/122980 | 10/2008 |
| WO | WO 2009/009142 | 1/2009 |
| WO | WO 2009/013750 | 1/2009 |
| WO | WO 2009/083958 | 7/2009 |
| WO | WO 2009/083973 | 7/2009 |
| WO | WO 2009/083974 | 7/2009 |
| WO | WO 2009/118721 | 10/2009 |
| WO | WO 2009/141824 | 11/2009 |
| WO | WO 2009/144311 | 12/2009 |
| WO | WO 2010/020941 | 2/2010 |
| WO | WO 2010/049897 | 5/2010 |
| WO | WO 2010/076756 | 7/2010 |
| WO | WO 2010/100595 | 9/2010 |
| WO | WO 2010/143138 | 12/2010 |
| WO | WO 2011/015985 | 2/2011 |
| WO | WO 2011/080674 | 7/2011 |
| WO | WO 2011/135527 | 11/2011 |
| WO | WO 2012/028993 | 3/2012 |
| WO | WO 2012/085862 | 6/2012 |
| WO | WO 2012/150598 | 11/2012 |
| WO | WO 2013/027223 | 2/2013 |
| WO | WO 2013/128448 | 9/2013 |

OTHER PUBLICATIONS

Guo et al (PNAS 2004 (101)25,9205-9210).*
Friedberg (Brief. Bioinformatics (2006) 7: 225-242).*
Translation of Notification of the Office Action Dated Dec. 1, 2011 From the State Intellectual Property Office of the People's Republic of China Re. Application No. 200680047610.0.
Response Dated Dec. 19, 2011 to Examiner's Report of Oct. 19, 2011 From the Australian Government, IP Australia Re. Application No. 2006281018.
Response Dated Jun. 29, 2011 to Communication Pursuant to Article 94(3) EPC of Mar. 8, 2011 From the European Patent Office Re.: Application No. 06809784.9.
Communication Pursuant to Rules 70(2) and 70a(2) EPC and Reference to Rule 39(1) EPC Dated Nov. 7, 2011 From the European Patent Office Re. Application No. 11172514.9.
Official Action Dated Dec. 21, 2011 From the US Patent and Trademark Office Re. U.S. Appl. No. 12/810,855.
Response Dated Jan. 10, 2012 to European Search Report and the European Search Opinion of Jun. 14, 2011 From the European Patent Office Re. Application No. 11154193.4.
Aharon et al. "Overexpression of A Plasma Membrane Aquaporin in Transgenic Tobacco Improves Plant Vigor Under Favorable Growth Conditions But Not Under Drought or Salt Stress", The Plant Cell, 15: 439-447, Feb. 2003.
Davletova et al. "The Zinc-Finger Protein Zat12 Plays a Central Role in Reactive Oxygen and Abiotic Stress Signaling in *Arabidopsis*", Plant Physiology, 139: 847-856, Oct. 2005.
Friedberg "Automated Protein Function Prediction—The Genomic Challenge", Briefings in Bioinformatics, 7(3): 225-242, 2006.
Communication Pursuant to Rules 70(2) and 70a(2) EPC and Reference to Rule 39(1) EPC Dated Dec. 5, 2011 From the European Patent Office Re. Application No. 10194223.3.
Examiner's Report Dated Jan. 10, 2012 From the Australian Government, IP Australia Re. Application No. 2005234725.
International Preliminary Report on Patentability Dated Dec. 2, 2010 From the International Bureau of WIPO Re. Application No. PCT/IL2009/000508.
Notice of Allowance Dated Oct. 18, 2010 From the US Patent and Trademark Office Re.: U.S. Appl. No. 11/990,386.
Office Action Dated Nov. 11, 2010 From the Israel Patent Office Re. Application No. 206118 and Its Translation Into English.
Official Action Dated Nov. 23, 2010 From the US Patent and Trademark Office Re. U.S. Appl. No. 12/083,978.
Response Dated Dec. 5, 2010 to Office Action of Aug. 4, 2010 From the Israel Patent Office Re.: Application No. 172135.
Response Dated Dec. 12, 2010 to Examiner's Report of Dec. 17, 2009 From the Australian Patent Office Re.: Application No. 2005252469.
Response Dated Dec. 14, 2010 to Examination Report of Sep. 22, 2010 From the Instituto Mexicano de la Propriedad Industrial Re. Application No. MX/a/2008/005280.
Response Dated Sep. 14, 2010 to Official Action of Aug. 18, 2010 From the US Patent and Trademark Office Re. U.S. Appl. No. 12/083,978.
Response Dated Oct. 24, 2010 to Office Action of Sep. 2, 2010 From the Rospatent, Federal State Institution, Federal Institute for Industrial Property of the Federal Service for Intellectual Property, Patents and Trademarks of the Russian Federation Re. Application No. 2008120395.
Summary of Office Action Dated Sep. 2, 2010 From the Rospatent, Federal State Institution, Federal Institute for Industrial Property of the Federal Service for Intellectual Property, Patents and Trademarks of the Russian Federation Re. Application No. 2008120395.
Translation of Office Action Dated Oct. 19, 2010 From the State Intellectual Property Office of the People's Republic of China Re. Application No. 200680038391.X.
Wang et al. "Control of Plant Trichome Development by A Cotton Fiber MYB Gene", The Plant Cell, 16: 2323-2334, Sep. 2004.
Wang et al. "Control of Plant Trichome Development by A Cotton Fiber MYB Gene", The Plant Cell, 16: 2323-2334, Sep. 2004. GenEmbl Database, Accession No. AY641990.
Examiner's Report Dated Jan. 13, 2012 From the Australian Government, IP Australia Re. Application No. 2011239323.
Response Dated Dec. 22, 2011 to Official Action of Aug. 22, 2011 From the US Patent and Trademark Office Re. U.S. Appl. No. 12/457,199.
Supplementary European Search Report and the European Search Opinion Dated Jan. 2, 2012 From the European Patent Office Re. Application No. 09807983.3.
Translation of Decision of Rejection Dated Dec. 9, 2011 From the State Intellectual Property Office of the People's Republic of China Re.: Application No. 200580027481.4.
Adachi et al. "*Oryza sativa* Japonica Group cDNA Clone:J023021L06, Full Insert Sequence", Database EMBASE [Online], XP002665608, Retrieved From EBI, Database Accession No. AK099270, Jul. 19, 2003.
Feng et al. "Probable Cinnamyl Alcohol Dehydrogenase 6", Darabase UniProt [Online], XP002665609, Retrieved From EBI, Database Accession No. Q7XWU3, Mar. 1, 2004.
Decision on Granting a Patent for Invention Dated Dec. 7, 2010 From the Rospatent, Federal State Institution, Federal Institute for Industrial Property of the Federal Service for Intellectual Property, Patents and Trademarks of the Russian Federation Re. Application No. 2008120395 and Its Translation Into English.
Communication Pursuant to Article 94(3) EPC Dated Jan. 12, 2011 From the European Patent Office Re. Application No. 08867385.0.
Communication Pursuant to Article 94(3) EPC Dated Dec. 21, 2010 From the European Patent Office Re. Application No. 08866783.7.
Communication Pursuant to Rule 58 EPC or Rule 159 EPC, Invitation to Remedy Deficiencies in the Application Documents Dated Jan. 19, 2012 From the European Patent Office Re. Application No. 11190922.2.
Communication Pursuant to Rules 70(2) and 70a(2) EPC Dated Jan. 19, 2012 From the European Patent Office Re. Application No. 09807983.3.
International Preliminary Report on Patentability Dated Oct. 7, 2010 From the International Bureau of WIPO Re. Application No. PCT/IL2008/001684.
International Preliminary Report on Patentability Dated Jul. 15, 2010 From the International Bureau of WIPO Re. Application No. PCT/IL2008/001683.

(56) References Cited

OTHER PUBLICATIONS

International Preliminary Report on Patentability Dated Jul. 15, 2010 From the International Bureau of WIPO Re. Application No. PCT/IL2008/001685.
International Search Report Dated Jun. 2, 2009 From the International Searching Authority Re.: Application No. PCT/IL2008/001683.
International Search Report Dated Apr. 14, 2009 From the International Searching Authority Re.: Application No. PCT/IL2008/001684.
International Search Report Dated May 18, 2009 From International Searching Authority Re.: Application No. PCT/IL2008/001685.
Response Dated Jul. 12, 2011 to Communication Pursuant to Article 94(3) EPC of Jan. 12, 2011 From the European Patent Office Re. Application No. 08867385.0.
Response Dated Jun. 21, 2011 to Communication Pursuant to Article 94(3) EPC of Dec. 21, 2010 From the European Patent Office Re. Application No. 08866783.7.
Translation of Office Action Dated Jun. 22, 2011 From the State Intellectual Property Office of the People's Republic of China Re. Application No. 200880127685.9.
Written Opinion Dated Jun. 2, 2009 From the International Searching Authority Re.: Application No. PCT/IL2008/001683.
Written Opinion Dated Apr. 14, 2009 From the International Searching Authority Re.: Application No. PCT/IL2008/001684.
Written Opinion Dated May 18, 2009 From the International Searching Authority Re.: Application No. PCT/IL2008/001685.
Agostini et al. "Evaluation of Feature-Based Registration in Dynamic Infrared Imaging for Breast Cancer Diagnosis", Proceedings of the 28th IEEE EMBS (Engineering in Medicine and Biology) Annual International Conference, New York City, USA, Aug. 30-Sep. 3, 2006, XP031235634, p. 953-956, Aug. 30, 2006. p. 953, § 2, 3.
Akscnov et al. "3D Thermography for Quantification of Heat Generation Resulting From Inflammation", Proceedings of the 8th 3D Modelling Symposium, Paris, France, XP))2523191, 11 P., 2003.
Bichinho et al. "A Computer Tool for the Fusion and Visualization of Thermal and Magnetic Resonance Images", Journal of Digital Imaging, XP002527797, 22(5): 527-534, Oct. 2009. p. 3, col. 1, Line 5-col. 2, Line 6, Fig. 1.
Deng et al., "Enhancement of Thermal Diagnostics on Tumors Underneath the Skin by Induced Evaporation", Proceedings of the 2005 27th Annual International Conference of the Engineering in Medicine and Biology Society, Shanghai, China, Sep. 1-4, 2005, IEEE-EMBS 2005, XP002519610, 7: 7525-7528, 2005. Passage Bridging p. 7526 and p. 7527, Abstract, Figs.4, 5.
Deng et al. "Mathematical Modeling of Temperature Mapping Over Skin Surface and Its Implementation in Thermal Disease Diagnostics", Computers in Biology and Medicine, XP002523192, 34(6): 495-521, Sep. 2004. Abstract, p. 497.
Kaczmarek et al. "Optical Excitation Methods in Active Dynamic Thermography in Medical Diagnostics", Proceedings of the SPIE—The International Society for Optical Engineering SPIE, XP002519609, 5566(1): 120-126, 2004. p. 121, Last §, p. 123, First §, Fig.3.
Lipari et at "Advanced Infrared Image Processing for Breast Cancer Risk Assessment", Proceedings of the 19th Annual International Conference of the IEEE/EMBS Engineering in Medicine and Biology Society, Chicago, IL, USA, Oct. 30-Nov. 2, 1997, XP010325780, 2: 673-676, Oct. 30, 1997. Abstract, Sections II, III, Fig.3.
Moderhak et al. "Problems of 3D Breast Imaging", Gdansk University of Technology, Department of Biomedical Engineering, 2 P.
Tan et al. "A Novel Cognitive Interpretation of Breast Cancer Thermography With Complementary Learning Fuzzy Neural Memory Structure", Expert Systems With Applications, XP005919120, 33(3): 652-666, Mar. 13, 2007. Abstract, p. 658-659, Section 4, Fig. 5.
Notice of Grant Dated Jan. 14, 2011 From the Instituto Mexicano de la Propriedad Industrial Re. Application No. MX/a/2008/005280.
International Search Report and the Written Opinion Dated Aug. 22, 2011 From the International Searching Authority Re: Application No. PCT/IB2010/56023.
Good et al. "Can Less Yield More? Is Reducing Nutrient Input Into the Environment Compatible With Maintaining Crop Production?", Trends in Plant Science, 9(12): 597-605, Dec. 2004.
Good et al. "Engineering Nitrogen Use Efficiency With Alanine Aminotransferase", Canadian Journal of Botany, 85: 252-262, 2007.
Yanagisawa et al. "Metabolic Engineering With Dof1 Transcription Factor in Plants: Improved Nitrogen Assimilation and Growth Under Low-Nitrogen Conditions", Proc. Natl. Acad. Sci USA PNAS, 101(20): 7833-7838, May 18, 2004.
Examiner's Report Dated Jan. 13, 2011 From the Australian Patent Office Re.: Application No. 2005252469.
Response Dated Jan. 19, 2011 to Supplementary European Search Report and the European Search Opinion of Jul. 1, 2010 From the European Patent Office Re. Application No. 07849616.3.
Blewitt et al. "*Gossypium hirsutum* Strain Acala Maxxa BURP Domain-Containing Protein (BNL1924) mRNA, Complete CDS", GenBank Nucleotide, GenBank Accession No. AY343972, Aug. 16, 2003.
Li et al. "isolation of Genes Preferntially Expressed in Cotton Fibers by cDNA Filter Arrays and RT-PCR", Plant Science, 163: 1113-1120, 2002. & GenBank Nucleotide "*Gossypium hirstutum* Dehydration-Iduced Protein RD22-Like Protein (RDL0 mRNA, Complete CDS", GenBank Accession No. AY072821, Dec. 4, 2002.
Examination Report Dated Dec. 19, 2011 From the Federal Service of Intellectual Property, Federal State Budget Institute, Federal Institute of Industrial Property of the Russian Federation Re. Application No. 2011113420 and Its Translation Into English.
Examiner's Report Dated Jan. 31, 2012 from the Australian Government, IP Australia Re. Application No. 2006281018.
Office Action Dated Jan. 2, 2012 From the Israel Patent Office Re. Application No. 206118 and Its Translation Into English.
Restriction Official Action Dated Feb. 13, 2012 From the US Patent and Trademark Office Re. U.S. Appl. No. 12/594,853.
Invitrogen "SuperScript® Plasmid System With Gateway® Technology for cDNA Synthesis and Cloning", Invitrogen by Life Technologies, User Manual, Catalog No. 18248-013, Manual Part No. 11108, 44 P., Dec. 22, 2010.
Translation of Office Action Dated Jan. 4, 2012 From the State Intellectual Property Office of the People's Republic of China Re. Application No. 200880109464.9.
Translation of Office Action Dated Jan. 17, 2012 From the State Intellectual Property Office of the People's Republic of China Re. Application No. 201110104274.1.
Translation of Office Action Dated Dec. 31, 2011 From the State Intellectual Property Office of the People's Republic of China Re. Application No. 200910217137.1.
Office Action Dated Feb. 3, 2011 From the Israel Patent Office Re.: Application No. 172135 and Its Translation Into English.
Official Action Dated Feb. 15, 2011 From the US Patent and Trademark Office Re. U.S. Appl. No. 12/448,359.
International Preliminary Report on Patentability Dated Mar. 3, 2011 From the International Bureau of WIPO Re.: Application No. PCT/IB2009/053633.
International Search Report and the Written Opinion Dated Jun. 2, 2010 From the International Searching Authority Re. Application No. PCT/IB09/53633.
Invitation to Pay Additional Fees Dated Mar. 2, 2010 From the International Searching Authority Re.: Application No. PCT/IB09/53633.
Communication Pursuant to Article 94(3) EPC Dated Feb. 14, 2012 From the European Patent Office Re.: Application No. 04734072.4.
Requisition by the Examiner Dated Feb. 2, 2012 From the Canadian Intellectual Property Office Re. Application No. 2,570,195.
Communication Pursuant to Article 94(3) EPC Dated Mar. 8, 2011 From the European Patent Office Re.: Application No. 06809784.9.
Communication Pursuant to Article 94(3) EPC Dated Mar. 14, 2011 From the European Patent Office Re. Application No. 07849616.3.
Response Dated Feb. 9, 2011 to Communication Pursuant to Article 94(3) EPC of Nov. 19, 2010 From the European Patent Office Re.: Application No. 06809784.9.

(56) References Cited

OTHER PUBLICATIONS

Response Dated Feb. 14, 2011 to Supplementary European Search Report and the European Search Opinion of Jul. 29, 2010 From the European Patent Office Re. Application No. 08776651.5.
Response Dated Mar. 14, 2011 to Official Action of Feb. 15, 2011 From the US Patent and Trademark Office Re. U.S. Appl. No. 12/448,359.
Communciation Pursuant to Rules 70(2) and 70a(2) EPC Dated Aug. 30, 2011 From the European Patent Office Re. Application No. 08738191.9.
Response Dated Feb. 23, 2011 to Communication Pursuant to Rule 70(2) EPC and Reference to Rule 39(1) EPC of Sep. 13, 2010 From the European Patent Office Re.: Application No. 09163033.5.
Response Dated Feb. 24, 2011 to Communciation Pursuant to Rules 70(2) and 70a(2) EPC of Aug. 30, 2011 From the European Patent Office Re. Application No. 08738191.9.
Examiner's Report Dated Mar. 31, 2011 From the Australian Government, IP Australia Re. : Application No. 2005252469.
Response Dated Mar. 8, 2011 to Examiner's Report of Jan. 13, 2011 From the Australian Government, IP Australia Re.: Application No. 2005252469.
Response Dated Mar. 9, 2011 to Office Action of Nov. 11, 2010 From the Israel Patent Office Re. Application No. 206118.
Response Dated Mar. 23, 2011 to Official Action of Nov. 23, 2010 From the US Patent and Trademark Office Re. U.S. Appl. No. 12/083,978.
Response Dated Mar. 24, 2011 to Examination Report of Nov. 3, 2010 From the Government of India, Patent Office Re.: Application No. 158/CHENP/2007.
International Preliminary Report on Patentability Dated Jan. 22, 2009 From the International Bureau of WIPO Re.: Application No. PCT/IL2006/001223.
Invitation to Pay Additional Fees Dated Feb. 7, 2008 From the International Searching Authority Re.: Application No. PCT/IL06/001223.
Communication Pursuant to Article 94(3) EPC Dated Nov. 27, 2009 From the European Patent Office Re.: Application No. 06809784.9.
International Search Report and the Written Opinion Dated Jul. 29, 2008 From the International Searching Authority Re.: Application No. PCT/IL06/001223.
Supplementary European Search Report and the European Search Opinion Dated Sep. 14, 2009 From the European Patent Office Re.: Application No. 06809784.9.
Gardiner et al. "*Zea mays* PCO131392 mRNA Sequence", Database EMBL/GenBank/DDBJ, EBI Database Accession No. AY107021, XP002542347, May 28, 2002. 96,5% Identity in 1118 nt Overlap of AY107021 (1118 nt) With SEQ ID No. 68 (1348 nt) of the Present Application, Abstract.
Grover et al. "Understanding Molecular Alphabets of the Plant Abiotic Stress Responses", Current Science, 80(2): 206-216, Jan. 25, 2001.
Liu et al. "Root-Specific Expression of a Western White Pine PR10 Gene Is Mediated by Different Promoter Regions in Transgenic Tobacco", Plant Molecular Biology, 52: 103-120, 2003.
Official Action Dated May 10, 2011 From the US Patent and Trademark Office Re. U.S. Appl. No. 12/457,199.
Official Action Dated Apr. 29, 2011 From the US Patent and Trademark Office Re. U.S. Appl. No. 12/448,359.
Response Dated Apr. 21, 2011 to Communication Pursuant to Article 94(3) EPC of Nov. 8, 2010 From the European Patent Office Re.: Application No. 04734072.4.
Supplementary European Search Report and the European Search Opinion Dated May 6, 2011 From the European Patent Office Re. Application No. 09750276.9.
Payne et al. "Heterologous MYB Genes Distinct From GL1 Enhance Trichome Production When Overexpressed in *Nicotiana tabacum*", Development, 126: 671-682, 1999.
Sunkar et al. "Small RNAs as Rig Players in Plant Abiotic Stress Responses and Nutrient Deprivation", Trends in Plant Science XP022148764, 12(7): 301-309, Jul. 1, 2007.

Communication Pursuant to Rules 70(2) and 70a(2) EPC Dated May 24, 2011 From the European Patent Office Re. Application No. 09750276.9.
Examination Report Dated Apr. 19, 2011 From the Instituto Mexican de la Propriedad Industrial Re. Application No. MX/a/2008/002262 and Its Summary Into English.
Communication Pursuant to Article 94(3) EPC Dated Dec. 8, 2008 From the European Patent Office Re.: Application No. 04734072.4.
International Preliminary Report on Patentability Dated Dec. 8, 2005 From the International Bureau of WIPO Re.: Application No. PCT/IL2004/000431.
Invitation to Pay Additional Fees Dated Dec. 18, 2008 From the International Searching Authority Re.: Application No. PCT/IL08/01024.
Communication Pursuant to Article 94(3) EPC Dated Sep. 9, 2009 From the European Patent Office Re.: Application No. 04734072.4.
Examination Report Dated Nov. 13, 2007 From the Government of India, Patent Office Re.: Application No. 3482/CHENP/2005.
International Preliminary Report on Patentability Dated Feb. 4, 2010 From the International Bureau of WIPO Re.: Application No. PCT/IL2008/001024.
International Preliminary Report on Patentability Dated Jan. 22, 2009 From the International Bureau of WIPO Re.: Application No. PCT/IL2006/000947.
International Search Report Dated Mar. 4, 2009 From the International Searching Authority Re.: Application No. PCT/IL08/01024.
International Search Report Dated Nov. 4, 2005 From the International Searching Authority Re.: Application No. PCT/IL04/00431.
International Search Report Dated Aug. 27, 2008 From the International Searching Authority Re.: Application No. PCT/IL06/00947.
Office Action Dated Jan. 9, 2009 From the State Intellectual Property Office of the People's Republic of China Re.: Application No. 200480020597.0.
Office Action Dated Apr. 27, 2009 From the Israeli Patent Office Re.: Application No. 172135 and Its Translation Into English.
Office Action Dated Jan. 31, 2010 From the Israel Patent Office Re.: Application No. 172135 and Its Translation Into English.
Office Letter Dated Jul. 7, 2008 From the Government of India, Patent Office Re.: Application No. 3482/CHENP/2005.
Official Action Dated May 15, 2009 From the US Patent and Trademark Office Re.: U.S. Appl. No. 11/990,386.
Official Action Dated Oct. 18, 2007 From the US Patent and Trademark Office Re.: U.S. Appl. No. 11/284,236.
Official Action Dated Oct. 22, 2009 From the US Patent and Trademark Office Re.: U.S. Appl. No. 11/990,386.
Official Action Dated Jul. 28, 2008 From the US Patent and Trademark Office Re.: U.S. Appl. No. 11/284,236.
Response Dated Jan. 7, 2010 to Communication Pursuant to Article 94(3) EPC of Sep. 9, 2009 From the European Patent Office Re.: Application No. 04734072.4.
Response Dated Feb. 22, 2010 to Official Action of Oct. 22, 2009 From the US Patent and Trademark Office Re.: U.S. Appl. No. 11/990,386.
Supplementary European Search Report and the European Search Opinion Dated Feb. 1, 2010 From the European Patent Office Re.: Application No. 06766224.7.
Supplementary European Search Report Dated Oct. 31, 2007 From the European Patent Office Re.: Application No. 04734072.4.
Supplementary Partial European Search Report Dated Aug. 30, 2007 From the European Patent Office Re.: Application No. 04734072.4.
Translation of the Office Action Dated Jan. 9, 2009 From the State Intellectual Property Office Re.: Application No. 2004800200597.0.
Written Opinion Dated Mar. 4, 2009 From the International Searching Authority Re.: Application No. PCT/IL08/01024.
Written Opinion Dated Nov. 4, 2005 From the International Searching Authority Re.: Application No. PCT/I104/00431.
Written Opinion Dated Aug. 27, 2008 From the International Searching Authority Re.: Application No. PCT/IL06/00947.
Alcala et al. "Generation of ESTs From Tomato Fruit Tissue", Database GenBank on STIC, National Center for Biotechnology Information, Accession No. AW932839, 2001.
Apse et al. "Engineering Salt Tolerance in Plants", Current Opinion in Biotechnology, 13: 146-150, 2002.

(56) References Cited

OTHER PUBLICATIONS

Brandle et al. "Perspectives on the Production of Recombinant Proteins in Plants", AgBiotechNet, 3(ABN 070): 1-4, 2001. Abstract.
Guo et al. "Protein Tolerance to Random Amino Acid Change", Proceedings of the National Academy of Sciences USA, 101(25): 9205-9210, 2004.
Hill et al. "Functional Analysis of Conserved Histidines in ADP-Glucose Pyrophosphorylase From *Escherichia Coli*", Biochemical and Biophysical Research Communications, 244(2): 573-577, 1998.
In et al. "Panax Gingseng mRNA for Cytoplasmic Ribosomal Protein S13, Complete Cds", Database EMBL [Online], Retrieved From EBI Accession No. EMBL, Database Accession No. AB043974, 2000.
Keskin et al. "A New, Structurally Nonredundant, Diverse Data Set of Protein—Protein Interfaces and Its Implications", Protein Science, 13: 1043-1055, 2004.
Kim et al. "Molecular Cloning of Low-Temperature-Inducible Ribosomal Proteins From Soybean", Journal of Experimental Botany, 55(399): 1153-1155, 2004.
Ngo et al. "Computational Complexity, Protein Structure Prediction, and the Levinthal Paradox", The Protein Folding Problem and Tertiary Structure Prediction, p. 433, 492-495.
Nuccio et al. "Metabolic Engineering of Plants for Osmotic Stress Resistance", Current Opinion in Plant Biology, XP002216348, 2(2): 128-134, Apr. 1, 1999.
Park et al. "Glycine Max Ribosomal Protein S13 (RPS13) mRNA, Complete Cds", Database EMBL [Online], Retreieved From EBI Accession No. EMBL, Database Accession No. AY453393, 2004.
Sáez-Vásquez et al. "Accumulation and Nuclear Targeting of BnC24, A *Brassica napus* Ribosomal Protein Corresponding to a mRNA Accumulating in Response to Cold Treatment", Plant Science, 156(1): 35-46, 2000.
Smart et al. "MIP Genes Are Down-Regulated Under Drought Stress in *Nicotiana glauca*", Plant and Cell Physiology, 42(7): 686-693, 2001. Referenc to Database Entry AF290618 on p. 686, p. 692, 1-h col., § 2.
Smart et al. "*Nicotiana glauca* Putative Delta TIP (MIP2) mRNA, Complete Cds", Database EMBL [Online], Retrieved From EMBL Accession No. EMBL: Af290618, Database Accession No. AF290618, 2001.
Tamura et al. "Osmotic Stress Tolerance of Transgenic Tobacco Expressing a Gene Encoding a Membrane-Located Receptor-Like Protein From Tobacco Plants", Plant Physiology, 131(2): 454-462, 2003.
Tanaka et al. "Enhanced Tolerance Against Salt-Stress and Freezing-Stress of *Escherichia coli* Cells Expressing Algal BBC1 Gene", Current Microbiology, 42(3): 173-177, 2001.
Thornton et al. "From Structure to Function: Approaches and Limitations", Nature Structural Biology. Structural Genomic Supplement, Nov. 2000, p. 991-994.
Van der Hoeven et al. "EST301294 Tomato Root During/After Fruit Set, Cornell University Lycopersicon Esculentum cDNA Clone cLEX1K11 Similar to *Vernicia fordii* Aquaporin, mRNA Sequence", Database EMBL [Online], Retrieved From EBI Accession No. EMBL: AW218814, Database Accession No. AW218814. Abstract.
Van der Hoeven et al. "EST301295 Tomato Root During/After Fruit Set, Cornell University Lycopersicon Esculentum cDNA Clone cLEX1K11 Similar to *Vernicia fordii* Aquaporin, mRNA Sequence", Database EMBL [Online], Retrieved From EBI Accession No. EMBL: AW218815, Database Accession No. AW218815. Abstract, 2000.
Van der Hoeven et al. "EST428934 Tomato Nutrient Deficient Roots Lycopersicon Esculentum cDNA Clone cLEW26B2 5' Sequence, mRNA Sequence", Database EMBL, Retrieved From EBI Accession No. EMBL, Database Accession No. BF098413, 2000.
Wells "Additivity of Mutational Effects in Proteins", Biochemistry, 29 (37): 8509-8517, 1990.
Examination Report Dated Feb. 17, 2010 From the Instituto Mexicano de la Propriedad Industrial Re. Application No. PA/a/2005/012565 and Its Summary in English.

Response Dated May 31, 2010 to Office Action of Jan. 31, 2010 From the Israel Patent Office Re.: Application No. 172135.
Communication Pursuant to Article 94(3) EPC Dated May 12, 2010 From the European Patent Office Re.: Application No. 06766224.7.
Requisition by the Examiner Dated Jun. 15, 2011 From the Canadian Intellectual Property Office Re. Application No. 2,526,440.
Communication Pursuant to Article 94(3) EPC Dated Jun. 29, 2011 From the European Patent Office Re. Application No. 08738191.9.
Response Dated Jun. 2, 2011 to Office Action of Feb. 3, 2011 From the Israel Patent Office Re.: Application No. 172135.
Communication Relating to the Results of the Partial International Search Dated Jul. 8, 2009 From the International Searching Authority Re.: Application No. PCT/IL2008/001657.
International Search Report and the Written Opinion Dated Oct. 30, 2009 From the International Searching Authority Re.: Application No. PCT/IL2008/001657.
Fray et al. "Nucleotide Sequence and Expression of a Ripening and Water Stress-Related cDNA From tomato With Homology to the MIP Class of Membrane Channel Proteins", Plant Molecular Biology [Online], XP009117320, 24(3): 539-543, 1994. Figs.1, 2. & Database UniProt, REcName: Full=Probable Aquaporin PIP-Type pTOM75; AltName: Full=Ripening-Associated Membrane Protein; Short=RAMP, Oct. 1, 1994.
Hachez et al. "Modulating the Expression of Aquaporin Genes in Planta: A Key to Understand Their Physiological Functions?", Biochimica et Biophysica Acta, XP005655605, 1758(8): 1142-1156, Aug. 1, 2006. p. 1151, col. 1, § 2-p. 1153, col. 1, § 1, Table 1.
Kirkness et al. "Lycopersicon Esculentum Clone 133453R, mRNA Sequence", Database EMBL [Online], XP002529190, Retrieved From EBI Accession No. EMBL:BT014251, Database Accession No. BT014251, May 12, 2004.
Maurel "Plant Aquaporins: Novel Functions and Regulation Properties", FEBS Letters, XP022078418, 581(12): 2227-2236, May 25, 2007. p. 2230, col. 2, Last §—p. 2231, col. 1, § 2, Fig. 1.
Wu et al. "SubName: Full=Major Intrinsic Protein", Database UniProt [Online], XP002529191, Retrieved From EBI Accession No. UNIPROT:AOFI89, Database Accession No. AOF189, Nov. 28, 2006.
Examiner's Report Dated Dec. 20, 2011 From the Australian Government, IP Australia Re. Application No. 2005234725.
Examiner's Report Dated Jun. 24, 2011 From the Australian Government, IP Australia Re. Application No. 2006281018.
Examiner's Report Dated Jun. 30, 2011 From the Australian Government, IP Australia Re. Application No. 2006307457.
Office Action Dated Jun. 19, 2011 From the Israel Patent Office Re. Application No. 199391 and Its Translation Into English.
Response Dated Jun. 9, 2011 to Examiner's Report of Dec. 20, 2011 From the Australian Government, IP Australia Re. Application No. 2005234725.
International Preliminary Report on Patentability Dated Jul. 8, 2010 From the International Bureau of WIPO Re.: Application No. PCT/IL2008/001657.
Office Action Dated Jun. 17, 2010 From the Israel Patent Office Re. Application No. 190918 and Its Translation Into English.
Response Dated Jun. 29, 2010 to Examination Report of Feb. 17, 2010 From the Instituto Mexicano de la Propriedad Industrial Re. Application No. PA/a/2005/012565.
European Search Report and the European Search Opinion Dated Jun. 14, 2011 From the European Patent Office Re. Application No. 11154193.4.
European Search Report and the European Search Opinion Dated Jun. 21, 2011 From the European Patent Office Re. Application No. 11154213.0.
Office Action Dated Jun. 20, 2011 From the Israel Patent Office Re. Application No. 190918 and Its Translation Into English.
Partial European Search Report Dated Jul. 12, 2011 From the European Patent Office Re. Application No. 10194223.3.
Response Dated Jun. 15, 2011 to Examiner's Report of Mar. 31, 2011 From the Australian Government, IP Australia Re.: Application No. 2005252469.
Li et al. "*Gossypium hirsutum* Dehydration-induced Protein RD22-Like Protein (RDL) mRNA, Complete CDS", FBI Accession No.

(56) References Cited

OTHER PUBLICATIONS

EMBL:AY072821, XP002639385, Database Accession No. AY072821, Dec. 4, 2002. Compound.
Purnelle et al. "*Arabidopsis thaliana* DNA Chromosome 3, BAC Clone F3C22", Database EMBL [Online], XP002640829, Retrieved From EBI Accession No. EMBL:AL353912, Database Accession No. AL 353912, Apr. 27, 2000. Compound.
Wing et al. "GA_Eb0026P18f *Gossypium arboreum* 7-10 Dpa Fiber Library *Gossypium arboreum* cDNA Clone GA_Eb0026P18f, mRNA Sequence", Database EMBL [Online], XP002640830, Retrieved From EBI Accession No. EMBL:BF277249, Database Accession No. BF277249, Nov. 20, 2000.
Yamada et al. "*Arabidopsis thaliana* Unknown Proein (At3g51610) mRNA, Complete CDS", Database EMBL [Online], XP002640828, Retrieved Fom EBI Accession No. EMBL:AY034915, Database Accession No. AY034915, Jun. 13, 2001. Compound.
Official Action Dated Jul. 8, 2011 From the US Patent and Trademark Office Re. U.S. Appl. No. 12/083,978.
Response Dated Jun. 17, 2011 to Examiner's Report of Mar. 31, 2011 From the Australian Government, IP Australia Re.: Application No. 2005252469.
Communication Pursuant to Rule 69 EPC—Reminder Concerning Payment of the Designation Fee (Art. 79(2) EPC) and of the Examination Fee (Art. 94(1) EPC)—and Invitation Pursuant to Rule 70a(1) EPC Dated Jul. 18, 2011 From the European Patent Office Re. Application No. 11154193.4.
Communication Pursuant to Rule 69 EPC—Reminder Concerning Payment of the Designation Fee (Art. 79(2) EPC) and of the Examination Fee (Art. 94(1) EPC)—and Invitation Pursuant to Rule 70a(1) EPC Dated Jul. 25, 2011 From the European Patent Office Re. Application No. 11154213.0.
Examiner's Report Dated Jul. 21, 2011 From the Australian Government, IP Australia Re. Application No. 2005234725.
Response Dated Jul. 3, 2011 to Examination Report of Apr. 19, 2011 From the Instituto Mexicano de la Propriedad Industrial Re. Application No. MX/a/2008/002262 and Its Summary Into English.
Response Dated Jun. 6, 2011 to Official Action of May 10, 2011 From the US Patent and Trademark Office Re. U.S. Appl. No. 12/457,199.
Response Dated Jul. 25, 2011 to Examiner's Report of Jul. 21, 2011 From the Australian Government, IP Australia Re. Application No. 2005234725.
Examination Report Dated Aug. 1, 2011 From the Government of India, Patent Office Re.: Application No. 158/CHENP/2007.
Examination Report Dated May 25, 2011 From the Government of India, Patent Office Re.: Application No. 158/CHENP/2007.
Examiner's Report Dated Aug. 1, 2011 From the Australian Government, IP Australia Re. Application No. 2005234725.
Response Dated Jul. 6, 2011 to Examiner's Report of Dec. 20, 2010 From the Australian Government, IP Australia Re. Application No. 2005234725.
Response Dated Jul. 20, 2011 to Examination Report of May 25, 2011 From the Government of India, Patent Office Re.: Application No. 158/CHENP/2007.
Translation of Notification of the First Office Action Dated Jun. 30, 2011 From the State Intellectual Property Office of the People's Republic of China Re. Application No. 200680047610.0.
Van der Hoeven et al. "EST312975 Tomato Root During/After Fruit Set, Cornell University *Solanum lycopersicum* cDNA Clone cLEX14O20-5- mRNA Sequence", GenBank, GenBank Accession No. AW622177.1.
Supplementary European Search Report and the European Search Opinion Dated Jul. 29, 2010 From the European Patent Office Re. Application No. 08776651.5.
International Search Report Dated Jun. 2, 2009 From the International Searching Authority Re. : Application No. PCT/IL2008/001683.
International Search Report Dated Apr. 14, 2009 From the International Searching Authority Re. : Application No. PCT/IL2008/001684.
International Search Report Dated May 18, 2009 From International Searching Authority Re. : Application No. PCT/IL2008/001685.
Response Dated Aug. 11, 2011 to Examination Report of Aug. 1, 2011 From the Government of India, Patent Office Re.: Application No. 158/CHENP/2007.
Translation of Office Action Dated Jul. 1, 2011 From the State Intellectual Property Office of the People's Republic of China Re. Application No. 200880017707.6.
Aksenov et al. "3D Thermography for Quantification of Heat Generation Resulting From Inflammation", Proceedings of the 8th 3D Modelling Symposium, Paris, France, XP))2523191, 11 P., 2003.
Deng et al. "Enhancement of Thermal Diagnostics on Tumors Underneath the Skin by Induced Evaporation", Proceedings of the 2005 27th Annual International Conference of the Engineering in Medicine and Biology Society, Shanghai, China, Sep. 1-4, 2005, IEEE-EMBS 2005, XP002519610, 7: 7525-7528, 2005. Passage Bridging p. 7526 and p. 7527, Abstract, Figs.4, 5.
Lipari et al. "Advanced Infrared Image Processing for Breast Cancer Risk Assessment", Proceedings of the 19th Annual International Conference of the IEEE/EMBS Engineering in Medicine and Biology Society, Chicago, IL, USA, Oct. 30-Nov. 2, 1997, XP010325780, 2: 673-676, Oct. 30, 1997. Abstract, Sections II, III, Fig.3.
Tan et al. "A Novel Cognitive Interpretation of Breast Cancer Thermography With Complementary Learning Fuzzy Neural Memory Structure", Expert Systems With Applications, XP005919120, 33(3): 652-666, Mar. 13, 2007. Abstract, p. 658-659, Section 4, Fig.5.
Yanagisawa et al. "Metabolic Engineering With Dofl Transcription Factor in Plants: Improved Nitrogen Assimilation and Growth Under Low-Nitrogen Conditions", Proc. Natl. Acad. Sci. USA, PNAS, 101(20): 7833-7838, May 18, 2004.
Invitation to Pay Additional Fees Dated Aug. 23, 2005 From the International Search Authority Re. Application No. PCT/IL2004/000431.
Official Action Dated Aug. 18, 2010 From the US Patent and Trademark Office Re. U.S. Appl. No. 12/083,978.
Advisory Action Before the Filing of an Appeal Brief Dated Aug. 5, 2011 From the US Patent and Trademark Office Re. U.S. Appl. No. 12/083,978.
Invitation to Pay Additional Fees Dated Aug. 18, 2011 From the International Searching Authority Re.: Application No. PCT/IL08/00489.
Katavic et al. "Utility of the *Arabidopsis* FAE1 and Yeast SLC1-1 Genes for Improvement in Erucic Acid and Oil Content in Rapeseed", Biochemical Society Transaction, 28(6): 935-937, Dec. 2000.
Office Action Dated Aug. 4, 2010 From the Israel Patent Office Re.: Application No. 172135 and Its Translation Into English.
International Search Report and the Written Opinion Dated Sep. 7, 2010 From the International Searching Authority Re. Application No. PCT/IB10/50871.
Invitation to Pay Additional Fees Dated Jun. 9, 2011 From the International Searching Authority Re. Application No. PCT/IB10/56023.
Gaxiola et al. "Drought- and Salt-Tolerant Plants Result From Overexpression of the AVP1 H+—Pump", Proc. Natl. Acad. Sci. USA, PNAS, 98(20): 11444-11449, Sep. 25, 2001.
Gowik et al. "cis-Regulatory Elements for Mesophyll-Specific Gene Expression in the C4 Plant *Flaveria trinervia*, the Promoter of the C4 Phosphoenolpyruvate Carboxylase Gene", The Plant Cell, 16: 1077-1090, 2004.
Hattori et al. "An Acetohydroxy Acid Synthase Mutant Reveals a Single Site Involved in Multiple Herbicide Resistance", Molecular and General Genetics, 246: 419-425, 1995. Abstract!
Holmström et al. "Drought Tolerance in Tobacco", Nature, 379: 683-684, 1996. Abstract!
Jiao et al.
Katavic et al. "Utility of the *Arabidopsis* FAE1 and Yeast SLC1-1 Genes for Improvements in Erucic Acid and Oil Content in Rapeseed", Biochemical Society Transactions, 28: 935-7, 2000. Abstract!
Pilon-Smits et al. "Improved Performance of Transgenic Fructan-Accumulating Tobacco under Drought Stress", Plant Physiology, 107: 125-130, 1995.

(56) References Cited

OTHER PUBLICATIONS

Quesada et al. "Genetic Architecture of NaCl Tolerance in *Arabidopsis*", Plant Physiology, 130: 951-963, 2002. Abstract!
Saijo et al. "Over-Expression of a Single Ca 2+—Dependent Protein Kinase Confers Both Cold and Salt/Drought Tolerance on Rice Plants", The Plant Journal 23(3): 319-327, 2000.
Skriver et al. "Cis-Acting DNA Elements Responsive to Gibberellin and Its Antagonist Abscisic Acid", Proceedings of the National Academy of Sciences USA 88: 7266-7270, 1991.
Tarczynski et al. "Stress Protection of Transgenic Tobacco by Production of the Osmolyte Mannitol", Science, 259: 508-510, 1993. Abstract!
van Haaren et al. "A Functional Map of the Fruit-Specific Promoter of the Tomato 2A11 Gene", Plant Molecular Biology, 21: 625-640, 1993. Abstract!
Vigcolas et al. "Increasing Seed Oil Content in Oil-Seed Rape (*Brassica napus* L.) by Over-Expression of a Yeast Glycerol-3-Phosphate Dehydrogenase Under the Control of a Seed-Specific Promoter", Plant Biotechnology Journal, 5 Issue: 431-441, 2007. Abstract!
Wang et al. "The Soybean Dof-Type Transcription Factor Genes, GmDof4 and GmDof11, Enhance Lipid Content in the Seeds of Transgenic *Arabidopsis* Plants", The Plant Journal, 52: 716-729, 2007. Abstract!
Xu et al. "Expression of a Late Embryogenesis Abundant Protein Gene, HVA1, From Barley Confers Tolerance to Water Deficit and Salt Stress in Transgenic Rice", Plant Physiology, 110: 249-257, 1996.
Yanagisawa et al. "Diversity and Similarity Among Recognition Sequences of Dof Transcription Factors", The Plant Journal, 17(2): 209-214, 1999.
Zabrouskov et al. "Oxidative Metabolism and the Physiological Age of Seed Potatoes Are Affected by Increased Alpha-Linolenate Content", Physiologia Plantarum, 116: 172-185, 2002.
International Preliminary Report on Patentability Dated Sep. 15, 2011 From the International Bureau of WIPO Re. Application No. PCT/IB2010/050871.
Official Action Dated Aug. 22, 2011 From the US Patent and Trademark Office Re. U.S. Appl. No. 12/457,199.
Johansson et al. "The Role of Aquaporins in Cellular and Whole Plant Water Balance," Biochimica et Biophysica Acta 1465: 324-342, 2000.
Whisstock et al. "Prediction of Protein Function from Protein Sequence and Structure," Quarterly Reviews of Biophysics 36 (3): 307-340, Aug. 2003.
Communication Pursuant to Article 94(3) EPC Dated Feb. 13, 2009 From the European Patent Office Re.: Application No. 05750089.4.
European Search Report and the European Search Opinion Dated Aug. 9, 2010 From the European Patent Office Re.: Application No. 09163033.5.
Examinees Report Dated Dec. 17, 2009 From the Australian Patent Office Re.: Application No. 2005252469.
International Preliminary Report on Patentability Dated Jan. 14, 2010 From the International Bureau of WIPO Re.: Application No. PCT/IL2008/000489.
International Preliminary Report on Patentability Dated Jan. 21, 2010 From the International Bureau of WIPO Re.: Application No. PCT/IL2007/001590.
International Preliminary Report on Patentability Dated Mar. 29, 2007 From the International Bureau of WIPO Re.: Application No. PCT/IL2005/000627.
International Preliminary Report on Patentability Dated Jan. 30, 2007 From the International Bureau of WIPO Re.: Application No. PCT/IL05/00627.
International Search Report and the Written Opinion Dated Nov. 24, 2008 From the International Searching Authority Re.: Application No. PCT/IL08/00489.
International Search Report Dated Jul. 2, 2009 From the International Searching Authority Re.: Application No. PCT/IL07/01590.
International Search Report Dated Jan. 3, 2007 From the International Searching Authority Re.: Application No. PCT/IL2005/000627.
Invitation to Pay Additional Fees Dated Sep. 8, 2006 From the International Searching Authority Re.: Application No. PCT/IL05/00627.
Notice of Allowance Dated Apr. 16, 2010 From the US Patent and Trademark Office Re.: U.S. Appl. No. 11/629,411.
Office Action Dated May 13, 2010 From the Israel Patent Office Re. Application No. 180022 and Its Translation Into English.
Office Action Dated Jan. 22, 2010 From the State Intellectual Property Office of the People's Republic of China Re.: Application No. 200580027481.4 and Its Translation Into English.
Official Action Dated May 1, 2009 From the US Patent and Trademark Office Re.: U.S. Appl. No. 11/629,411.
Official Action Dated Sep. 2, 2009 From the US Patent and Trademark Office Re.: U.S. Appl. No. 11/629,411.
Official Action Dated Jun. 8, 2010 From the US Patent and Trademark Office Re.: U.S. Appl. No. 11/629,411.
Partial European Search Report Dated Apr. 19, 2010 From the European Patent Office Re.: Application No. 09163033.5.
Response Dated Jan. 4, 2010 to Official Action of Sep. 2, 2009 From the US Patent and Trademark Office Re.: U.S. Appl. No. 11/629,411.
Response Dated May 17, 2010 to Office Action of Jan. 22, 2010 From the State Intellectual Property Office of the People's Republic of China Re.: Application No. 200580027481.4.
Supplementary European Search Report and the European Search Opinion Dated Jul. 1, 2010 From the European Patent Office Re. Application No. 07849616.3.
Supplementary European Search Report and the European Search Opinion Dated Aug. 11, 2010 From the European Patent Office Re. Application No. 08738191.9.
Supplementary European Search Report Dated Apr. 23, 2008 From the European Patent Office Re.: Application No. 05750089.4.
Translation of Notice of Payment of the Restoration Fee for Unity of invention Dated Mar. 20, 2009 From the State Intellectual Property Office of the People's Republic of China Re.: Application No. 200580027481.4.
Written Opinion Dated Jul. 2, 2009 From the International Searching Authority Re.: Application No. PCT/IL07/01590.
Written Opinion Dated Jan. 3, 2007 From the International Searching Authority Re.: Application No. PCT/IL2005/000627.
Blewitt et al. "BNLGHi10083 Six-Day Cotton Fiber *Gossypium hirsutum* cDNA 5' Similar to (AC004521) Unknown Protein [*Arabidopsis thaliana*], mRNA Sequence", XP002576188, Retrieved Fron EBI Accession No. EMBL:AI728187, Database Accession No. AI728187, Jun. 12, 1999. Sequence.
Blewitt et al. "BNLGHi8081 Six-Day Cotton Fiber *Gossypium hirsutum* cDNA 5' Similar to (AC004521) Unknown Protein [*Arabidopsis thalian*], mRNA Sequence", XP002576189, Retrieved From EBI Accesion No. EMBL:AI730835, Database Accession No. AI730835, Jun. 12, 1999. Sequence.
Blewitt et al. "BNLGHi8396 Six-Day Cotton Fiber *Gossypium hirsutum* cDNA 5' Similar to (AC004521) Unknown Protein [*Arabidopsis thaliana*], mRNA Sequence", XP002576190, Retrieved From EBI Accession No. EMBL:AI27553, Database Accession No. AI27553, Jun. 12, 1999. Sequence.
Bowie et al. "Deciphering the Message in Protein Sequences: Tolerance to Amino Acid Substitutions", Science, 247(4948): 1306-1310, Mar. 16, 1990.
Cheuk et al. "*Arabidopsis thaliana* At2g46960/F14M4.21 mRNA, Complete CDS", Database EMBL [Online], XP002593835, Retrieved From EBI Accession No. EMBL:AY091688, Database Accession No. AY091688, Apr. 14, 2002.
François et al. "Overexpression of the VvLTP1 Gene Interferes With Somatic Embryo Development in Grapevine", Functional Plant Biology, 35(5): 394-402, 2008.
Ji et al. "*Gossypium hirsutum* Expansin mRNA, Complete CDs", XP002474936, Retrieved From EBI Accession No. EMBL:AY189969, Database Accession No. AY189969.
Ji et al. "Isolation and Analyses of Genes Preferentially Expressed During Early Cotton Fiber Development by Subtractive PCR and cDNA Array", Nucleic Acids Research, XP002474935, 31(10): 2534-2543, May 15, 2003.

(56) References Cited

OTHER PUBLICATIONS

Kim et al. "*Arabidopsis thaliana* At2g46960/F14M4.21 mRNA, Complete CDS", Database EMBL [Online], XP002593834, Retrieved From EBI Accession No. EMBL:AF367329, Database Accession No. AF367329, Apr. 12, 2001.
Kirubakaran et al. "Characterization of a New Antifungal Lipid Transfer Protein From Wheat", Plant Physiology and Biochemistry, 46: 918-927, 2008.
McConnell et al. "Role of PHABULOSA and PHAVOLUTA in Determining Radial Patterning in Shoots", Nature, 411(6338): 709-713, Jun. 7, 2001.
Merriam-Webster "Exogenous Definition", Merrian-Webster On-Line Dictionary, 2010.
NCBI "Protein Sequence (588 Letters)", NCBI BLAST Basic Local Alignment Search Tool, 3 P., Retrieved From the Internet on Nov. 24, 2009.
Orford et al. "Specific Expression of an Expansin Gene During Elongation of Cotton Fibres", Biochimica et Biophysica Acta, XP000866032, 1398(3): 342-346, Jul. 9, 1998. Abstract, p. 343, Fig.1.
Orzaez et al. "Agroinjection of Tomato Fruits. A Tool for Rapid Functional Analysis of Transgenes Directly in Fruit", Plant Physiology, 140: 3-11, 2006.
Udall et al. "A Global Assembly of Cotton ESTs", Genome Research, 16(3): 441-450, 2006.
Wallace et al. "Oligonucleotide Probes for the Screening of Recombinant DNA Libraries", Methods in Enzymology, XP002957829, 152: 432-442, Jan. 1, 1987.
Wing et al. "An Integrated Analysis of the Genetics, Devlopment, and Evolution of Cotton Fiber", NBCI GenBank Accession No. BE052336, 2000.
Wing et al. "GA_Eb0023F09f *Gossypium arboreum* 7-10 Dpa Fiber Library *Gossypium arboreum* cDNA Clone GA_Eb0023F09f, mRNA Sequence", XP002576191, Retrieved From EBI Accession No. EMBL:BF275177, Database Accession No. BF275177, Nov. 20, 2000. Sequence.
Response Dated Sep. 13, 2010 to Office Action Dated May 13, 2010 From the Israel Patent Office Re. Application No. 180022.
Response Dated Sep. 25, 2011 to Examiner's Report of Jun. 30, 2011 From the Australian Government, IP Australia Re. Application No. 2006307457.
Communication Pursuant to Rule 70(2) EPC and Reference to Rule 39(1) EPC Dated Sep. 13, 2010 From the European Patent Office Re.: Application No. 09163033.5.
Official Action Dated Sep. 19, 2011 From the US Patent and Trademark Office Re. U.S. Appl. No. 12/810,855.
European Search Report and the European Search Opinion Dated Oct. 6, 2011 From the European Patent Office Re. Application No. 11172514.9.
Taliercio et al. "GH_TMIRS_129_G10_F Cooton Normalized Library dT Primed *Gossypium hirsutum* cDNA, mRNA Sequence", EMBL-Bank, XP002659970, Retrieved From EBI Accession No. EM EST:DW508992, Database Accession No. DW508992.
Taliercio et al. "GH_TMIRS_129_G10_R Cotton Normalized Library dT Primed *Gossypium hirsutum* cDNA, mRNA Sequence", EMBL-Bank, XP002659971, Retrieved From EBI Accession No. EM_EST:DW508993, Database Accession No. DW508993.
Response Dated Oct. 3, 2011 to Examiner's Report of Jun. 24, 2011 From the Australian Government, IP Australia Re. Application No. 2006281018.
Response Dated Oct. 4, 2011 to Official Action of Jul. 8, 2011 From the US Patent and Trademark Office Re. U.S. Appl. No. 12/083,978.
Response Dated Sep. 21, 2010 to Notice of Allowance of Apr. 16, 2010 From the US Patent and Trademark Office Re.: U.S. Appl. No. 11/629,411.
Office Action Dated Sep. 22, 2011 From the Israeli Patent Office Re. Application No. 201242 and Its Translation Into English.
Response Dated Oct. 17, 2011 to Requisition by the Examiner of Jun. 15, 2011 From the Canadian Intellectual Property Office Re. Application No. 2,526,440.
Chames et al. "Direct Selection of a Human Antibody Fragment Directed Against the Tumor T-Cell Epitope HLA-A1-MAGE-A1 From a Nonimmunized Phage-Fab Library", Proc. Natl. Acad. Sci. USA, PNAS, XP002967292, 97(14): 7969-7974, Jul. 5, 2000.
Response Dated Oct. 12, 2010 to Communication Pursuant to Article 94(3) EPC of May 12, 2010 From the European Patent Office Re.: Application No. 06766224.7.
Response Dated Oct. 14, 2010 to Office Action of Jun. 17, 2010 From the Israel Patent Office Re. Application No. 190918.
Examiner's Report Dated Dec. 17, 2009 From the Australian Patent Office Re.: Application No. 2005252469.
Notice of Allowance Dated Aug. 11, 2010 From the Instituto Mexicano de la Propriedad Industrial Re. Application No. PA/a/2005/012565.
Blewitt et al. "BNLGHi10083 Six-Day Cotton Fiber *Gossypium hirsutum* cDNA 5' Similar to (AC004521) Unknown Protein [*Arabidopsis thaliana*], mRNA Sequence", XP002576188, Retrieved Fron EBI Accession No. EMBL:AI728187, Database Accession No. AI728187, Jun. 12, 1999. Sequence.
Maurel "Plant Aquaporins: Novel Functions and Regulation Properties", FEBS Letters, XP022078418, 581(12): 2227-2236, May 25, 2007. p. 2230, col. 2, Last §—p. 2231, col. 1, § 2, Fig.1.
Van der Hoeven et al. "EST301295 Tomato Root During/After Fruit Set, Cornell University Lycopersicon Esculentum cDNA Clone cLEX1K11 Similar to *Vernicia fordii* Aquaporin, mRNA Sequence", Database EMBL [Online], Retrieved From EBI Accession No. EMBL: AW218815, Database Accession No. AW218815. Abstract.
Wu et al. "SubName: Full=Major Intrinsic Protein", Database UniProt [Online], XP002529191, Retrieved From EBI Accession No. UNIPROT:AOFI89, Database Accession No. AOFI89, Nov. 28, 2006.
European Search Report and the European Search Opinion Dated Nov. 2, 2011 From the European Patent Office Re. Application No. 10194223.3.
Examine's Report Dated Oct. 19, 2011 From the Australian Government, IP Australia Re. Application No. 2006281018.
Examine's Report Dated Oct. 28, 2011 From the Australian Government, IP Australia Re. Application No. 2006307457.
International Search Report and the Written Opinion Dated Oct. 31, 2011 From the International Searching Authority Re.: Application No. PCT/IL08/00489.
Response Dated Oct. 19, 2011 to Official Action of Apr. 29, 2011 From the US Patent and Trademark Office Re. U.S. Appl. No. 12/448,359.
Response Dated Oct. 27, 2011 to Communication Pursuant to Article 94(3) EPC of Jun. 29, 2011 From the European Patent Office Re. Application No. 08738191.9.
Response Dated Oct. 27, 2011 to Office Action of Jul. 1, 2011 From the State Intellectual Property Office of the People's Republic of China Re. Application No. 200880017707.6.
Response Dated Oct. 27, 2011 to Supplementary European Search Report and the European Search Opinion of May 6, 2011 From the European Patent Office Re. Application No. 09750276.9.
Response Dated Oct. 31, 2011 to Notification of the First Office Action of Jun. 30, 2011 From the State Intellectual Property Office of the People's Republic of China Re. Application No. 200680047610.0.
Kandel et al. "Cloning, Functional Expression, and Characterization of CYP709C1, the First Sub-Terminal Hydroxylase of Long Chain Fatty Acid in Plants", Journal of Biological Chemistry, JBC, 280(43): 35881-35889, Oct. 28, 2005. p. 35887, col. 1, Para 2.
Response Dated Oct. 18, 2011 to Official Action of Sep. 19, 2011 From the US Patent and Trademark Office Re. U.S. Appl. No. 12/810,855.
International Preliminary Report on Patentability Dated Dec. 1, 2011 From the International Bureau of WIPO Re. Application No. PCT/IL2008/000489.
Lin et al. "*Arabidopsis thaliana* Chromosome III BAC F7018 Genomic Sequence, Complete Sequence", GenBank Accession No. AC011437, Oct. 30, 2002.
International Search Report and the Written Opinion Dated Dec. 6, 2011 From the International Searching Authority Re. Application No. PCT/IB32011/051843.

(56) References Cited

OTHER PUBLICATIONS

Notice of Allowance Dated Dec. 5, 2011 From the US Patent and Trademark Office Re. U.S. Appl. No. 12/448,359.
Response Dated Dec. 15, 2011 to Examiner's Report of Aug. 1, 2011 From the Australian Government, IP Australia Re. Application No. 2005234725.
Communication Pursuant to Article 94(3) EPC Dated Nov. 8, 2010 From the European Patent Office Re.: Application No. 04734072.4.
Communication Pursuant to Article 94(3) EPC Dated Nov. 19, 2010 From the European Patent Office Re.: Application No. 06809784.9.
Examination Report Dated Nov. 3, 2010 From the Government of India, Patent Office Re.: Application No. 158/CHENP/2007.
Examination Report Dated Sep. 22, 2010 From the Instituto Mexican de la Propriedad Industrial Re. Application No. MX/a/2008/005280 and Its Summary Into English.
International Search Report and the Written Opinion Dated Feb. 17, 2010 From the International Searching Authority Re.: Application No. PCT/IL09/00508.
Invitation to Pay Additional Fees Dated Nov. 19, 2009 From the International Searching Authority Re.: Application No. PCT/IL09/00508.
Office Action Dated Oct. 18, 2010 From the Israel Patent Office Re. Application No. 180022 and Its Translation Into English.
Yamada e tal. "*Arabidopsis thaliana* Clone RAFL14-87-A16 (R20399) Unknown Protein (At1g60770) mRNA, Complete Cds", GenBank Accession No. BT002876, Retrieved From the internet, Jan. 21, 2010.
Communication Pursuant to Article 94(3) EPC Dated Jan. 3, 2013 From the European Patent Office Re. Application No. 09807983.3.
English Summary of Examination Results Dated Dec. 28, 2012 From the National Office of Intellectual Property (NOIP) of Vietnam Re. Application No. 1-2009-02358.
International Search Report and the Written Opinion Dated Jan. 7, 2013 From the International Searching Authority Re. Application No. PCT/IL2012/050154.
Invitation to Pay Additional Fees Dated Dec. 31, 2012 From the International Searching Authority Re. Application No. PCT/IL2012/050327.
Examiner's Report Dated Mar. 15, 2012 From the Australian Government, IP Australia Re. Application No. 2011239323.
Communication Pursuant to Rule 55 EPC Dated Mar. 16, 2012 From the European Patent Office Re. Application No. 11190921.4.
Restriction Official Action Dated Apr. 11, 2012 From the US Patent and Trademark Office Re. U.S. Appl. No. 12/834,106.
Communication Pursuant to Article 94(3) EPC Dated Apr. 3, 2012 From the European Patent Office Re. : Application No. 06766224.7.
Invitation to Pay Additional Fees Dated May 8, 2012 From the International Searching Authority Re. Application No. PCT/IB11/53697.
Translation of Office Action Dated Apr. 9, 2012 From the State Intellectual Property Office of the People's Republic of China Re. Application No. 200880017707.6.
Official Action Dated May 14, 2012 From the US Patent and Trademark Office Re. U.S. Appl. No. 12/457,199.
Communication Pursuant to Article 93(3) EPC Dated Jun. 15, 2012 From the European Patent Office Re. Application No. 11154193.4.
Communication Pursuant to Article 94(3) EPC Dated Jun. 21, 2012 From the European Patent Office Re. Application No. 11154213.0.
Official Action Dated Jun. 13, 2012 From the US Patent and Trademark Office Re. U.S. Appl. No. 12/594,853.
Blast "BLAST Results", 1 P.
Communication Under Rule 71(3) EPC Dated Jun. 5, 2012 From the European Patent Office Re.: Application No. 06809784.9.
Official Action Dated Jun. 19, 2012 From the US Patent and Trademark Office Re. U.S. Appl. No. 13/450,547.
Communication Pursuant to Article 94(3) EPC Dated Jul. 4, 2012 From the European Patent Office Re. Application No. 10194223.3.
Examination Report Dated Jun. 6, 2012 From the Federal Service of Intellectual Property, Federal State Budget Institute, Federal Institute of Industrial Property of the Russian Federation Re. Application No. 2011113420 and Its Translation Into English.
Supplementary European Search Report and the European Search Opinion Dated Jul. 6, 2012 From the European Patent Office Re. Application No. 10748403.2.
Ishikawa et al. JP 2005-185101: Full Length cDNA of Plant and the Use Thereof, Database EMBL [Online], XP002678022, Retrieved From EBI Accession No. EM_PAT:IIV067703, Database Accession No. IIV067703, Jul. 15, 2011. Sequence.
Kikuchi et al. "Rice cDNA-Encoded Protein SEQ ID No. 31047", Database Geneseq [Online], XP002678021, Retrieved From EBI Accession No. GSP:AQD37188, Database Accession No. AGD37188, Jun. 12, 2008. Shows 100% Identity to Present SEG ID No:246 (Protein) and Corresponding Polynucleotide Shows 100 % Identity to SEQ ID No:7 Over 458 Nucleotides. Abstract.
La Rosa et al. "*Oryza sativa* Amino Acid Sequence SEQ ID No. 133688", Database Geneseq [Online], XP002678023, Retrieved From EBI Accession No. GSP:ANM19687, Database Accession No. ANM19687, Dec. 28, 2007. 100% Identity to Present SEQ IFD No:246, Corresponding Polynucleotide Has 99,6% Identity to Present SEQ ID No:7 Over 488 Nucleotides. Abstract, Sequence.
La Rosa et al. "*Oryza sativa* Nucleotide Sequence SEQ ID No. 31205", Database Geneseq [Online], XO002678024, Retrieved From EBI Accession No. GSN:ANL17203, Database Accession No. ANL17203, Dec. 28, 2007. Sequence.
Communication Pursuant to Article 94(3) EPC DAted Jul. 13, 2012 From the European Patent Office Re. Application No. 11172514.9.
Examination Report Dated Jun. 11, 2012 From the Instituto Mexicano de la Propiedad Industrial Re. Application No. MX/a/2011/007294 and Its Translation Into English.
Official Action Dated Jul. 17, 2012 From the US Patent and Trademark Office Re. U.S. Appl. No. 12/834,106.
Kano-Murakami et al. "A Rice Homeotic Gene, OSH1, Causes Unusual Phenotypes in Transgenic Tobacco", FEBS Letters, 334(3): 365-368, Nov. 1993.
Communication Pursuant to Rules 70(2) and 70a(2) EPC Dated Jul. 24, 2012 From the European Patent Office Re. Application No. 10748403.2.
International Preliminary Report on Patentability Dated Jul. 12, 2012 From the International Bureau of WIPO Re. Application No. PCT/IB2010/056023.
Office Action Dated Jun. 25, 2012 From the State Intellectual Property Office of the People's Republic of China Re.: Application No. 200880109464.9 and Its Translation Into English.
International Search Report and the Written Opinion Dated Aug. 6, 2012 From the International Searching Authority Re. Application No. PCT/IB11/53697.
Daniell et al. "*Solanum bulbocastanum* Chloroplast, Complete Genome", GenBank NCBI, Accession No. NC_007943, Mar. 26, 2010. p. 1, Source, p. 10-11, Nucleotides 46590-47195, Gene 'RPS4'.
Bernhardt et al. "The bHLH Genes GLABRA3 (GL3) and Enhancer of GLABRA3 (EGL3) Specify Epidermal Cell Fate in the *Arabidopsis* Root", Development, 130(26): 6431-6439, 2003.
Payne et al. "GL3 Encodes A bHLH Protein That Regulates Trichome Development in *Arabidopsis* Through Interaction With GL1 and TTG1", Genetics, 156: 1349-1362, Nov. 2000.
Advisory Action Before the Filing of an Appeal Brief Dated Aug. 29, 2012 From the US Patent and Trademark Office Re. U.S. Appl. No. 12/457,199.
Examination Report Dated Aug. 16, 2012 From the Instituto Mexicano de la Propiedad Industrial Re. Application No. MX/a/2010/014097 and Its Translation Into English.
Communication Pursuant to Rules 70(2) and 70a(2) EPC Dated May 7, 2012 From the European Patent Office Re. Application No. 09823171.5.
Examination Report Dated Sep. 14, 2012 From the Australian Government IP Australia Re. Application No. 2007335706.
Examination Report Dated Jun. 25, 2012 From the Instituto Mexicano de la Propiedad Industrial Re. Application No. MX/a/2011/003575 and Its Translation Into English.

(56) References Cited

OTHER PUBLICATIONS

International Preliminary Report on Patentability Dated Apr. 12, 2012 From the Interanational Bureau of WIPO Re. Application No. PCT/IB2010/052545.
International Preliminary Report on Patentability Dated May 12, 2011 From the International Bureau of WIPO Re. Application No. PCT/IB2009/054774.
International Search Report and the Written Opinion Dated Jun. 2, 2010 From the International Searching Authority Re.: Application No. PCT/IB09/54774.
International Search Report and the Written Opinion Dated Sep. 6, 2012 From the international Searching Authority Re. Application No. PCT/IB2011/055854.
International Search Report and the Written Opinion Dated Mar. 16, 2012 From the International Searching Authority Re. Application No. PCT/IB2010/052545.
Invitation to Pay Additional Fees Dated Jun. 15, 2012 From the International Searching Authority Re. Application No. PCT/IB2011/055854.
Invitation to Pay Additional Fees Dated Dec. 27, 2011 From the International Searching Authority Re. Application No. PCT/IB2010/052545.
Supplementary European Search Report and the European Search Opinion Dated Apr. 18, 2012 From the European Patent Office Re. Application No. 09823171.5.
Translation of Examination Report Dated Sep. 6, 2010 From the Government of the People's Republic of Bangladesh, Department of Patents, Designs and Trademarks, Ministry of Industries Re. Application No. 275/2009.
Translation of Office Action Dated Sep. 13, 2012 From the State Intellectual Property Office of the People's Republic of China Re. Application No. 200910217137.1.
Bautista et al. "*Arabidopsis thaliana* At5g06690 mRNA, Complete Cds", Unpublished, the Salk Institute for Biological Studies, La Jolla, CA, USA, GenBank: BT029447, Nov. 15, 2006.
Castelli et al. "*Arabidopsis thaliana* Full-Length cDNA Complete Sequence From Clone GSLTFB52ZA10 of Flowers and Buds of Strain Col-0 of *Arabidopsis thaliana* (Thale Cress)", GeneBank Direct Submission BX829993, Accession No. BX829993, Feb. 6, 2004.
Matsumoto et al. "Hordeum Vulgare Subsp. Vulgare, Full-Length cDNA", UniProtKB/TrEMBL, ID: F2DLE8-HORVD, UniProt Accession No. F2DLE8, May 31, 2011.
Rounsley et al. "*Arabidopsis thaliana* Chromosome 2 Clone T2P4 Map CIC10A06, Complete Sequence", Database EMBL [Online], XP002673500, Retrieved From EBI Accession No. EMBL:AC002336, Database Accession No. AC002336, Jul. 18, 1997. Sequence.
Takahashi et al. "The DNA Replication Checkpoint Aids Survival of Plants Deficient in the Novel Replisome Factor ETG1", The EMBO Journal, XP002537888, 27(13): 1840-1851, Jul. 9, 2008 & Supplementary Materials and Methods. Suppl. Fig.S6, p. 1844-1845.
Invitation to Pay Additional Fees Dated Oct. 17, 2012 From the International Searching Authority Re. Application No. PCT/IL2012/050154.
Communication Pursuant to Article 94(3) EPC Dated Oct. 23, 2012 From the European Patent Office Re. Application No. 11154193.4.
Requisition by the Examiner Dated Oct. 3, 2012 From the Canadian Intellectual Property Office Re. Application No. 2,526,440.
Translation of Notice of Paying Restoration Fee for Unity of Invention Dated Oct. 29, 2012 From the State Intellectual Property Office of the People's Republic of China Re. Application No. 200880127757.X.
Alcala et al. "EST543159 Tomato Callus Solanum Lycopersicum cDNA Clone cLEC80A19 5-end, mRNA Sequence", GenBank: BI923254.1, GenDank Accession No. BI923254, Oct. 17, 2001.
Restriction Official Action Dated Nov. 13, 2012 From the US Patent and Trademark Office Re. U.S. Appl. No. 12/992,902.

Backhaus et al. "Nucleotide Sequence of A cDNA for A P2 60S Acidic Ribosomal Protein From *Parthenium argentatum*", Plant Physiology, 106: 395, 1994.
Del Pozo et al. "F-Box Proteins and Protein Degradation: An Emerging Theme in Cellular Regulation", Plant Molecular Biology, 44(2): 123-128, Sep. 2000.
Harwood "Plant Fatty Acid Synthesis", The AOCS Lipid Library, 11 P., Apr. 12, 2010.
Notice of Allowance Dated Nov. 19, 2012 From the US Patent and Trademark Office Re. U.S. Appl. No. 13/450,547.
Communication Under Rule 71(3) EPC Dated Nov. 19, 2012 From the European Patent Office Re. Application No. 08738191.9.
Communication Pursuant to Article 94(3) EPC Dated Oct. 23, 2012 From the European Patent Office Re. Application No. 11154213.0.
Examination Report Dated Oct. 15, 2012 From the Instituto Mexicano de la Propiedad Industrial Re. Application No. MX/a/2009/006660 and Its Translation Into English.
Patent Examination Report Dated Dec. 12, 2012 From the Australian Government, IP Australia Re. Application No. 2008236316.
Communication Pursuant to Article 94(3) EPC Dated Dec. 19, 2012 From the European Patent Office Re.: Application No. 04734072.4.
Official Action Dated Dec. 18, 2012 From the US Patent and Trademark Office Re. U.S. Appl. No. 12/834,106.
Benfey et al. "The CaMV 35S Enhancer Contains at Least Two Domains Which Can Confer Different Development and Tissue-Specific Expression Patterns", The EMBO Journal, 8(8): 2195-2202, 1989.
Benfey et al. "The Cauliflower Mosaic Virus 35S Promoter: Combinatorial Regulation of Transcription in Plants", Science, 250(4983): 959-966, Nov. 16, 1990.
Communication Pursuant to Rules 70(2) and 70a(2) EPC Dated Aug. 30, 2010 From the European Patent Office Re. Application No. 08738191.9.
Examination Report Dated Jun. 11, 2012 From the Instituto Mexicano de la Propiedad Industrial Re. Application No. MX/a/2011/007294 and Summary in English.
Communication Pursuant to Article 94(3) EPC Dated May 8, 2013 From the European Patent Office Re. Application No. 08776651.5.
Examination Report Dated Mar. 23, 2013 From the Government of India, Patent Office, Intellectual Property Building Re. Application No. 2570/CHENP/2008.
International Preliminary Report on Patentability Dated Mar. 14, 2013 From the International Bureau of WIPO Re. Application No. PCT/IB2011/053697.
International Search Report and the Written Opinion Dated Apr. 10, 2013 From the International Searching Authority Re. Application No. PCT/IL2012/050327.
International Search Report and the Written Opinion Dated May 12, 2013 From the International Searching Authority Re. Application No. PCT/IL2013/050172.
Invitation to Pay Additional Fees Dated Apr. 8, 2013 From the International Searching Authority Re. Application No. PCT/IL2013/050172.
Notice of Allowance Dated Apr. 8, 2013 From the US Patent and Trademark Office Re. U.S. Appl. No. 12/594,853.
Office Action Dated Apr. 1, 2013 From the State Intellectual Property Office of the People's Republic of China Re. Application No. 200880127757.X and Its Translation Into English.
Official Action Dated May 8, 2013 From the US Patent and Trademark Office Re. U.S. Appl. No. 13/125,047.
Requisition by the Examiner Dated Apr. 11, 2013 From the Canadian Intellectual Property Office Re. Application No. 2,626,592.
Requisition by the Examiner Dated Mar. 25, 2013 From the Canadian Intellectual Property Office Re. Application No. 2,619,114.
Restriction Official Action Dated Apr. 4, 2013 From the US Patent and Trademark Office Re. U.S. Appl. No. 13/125,047.
Translation of Office Action Dated Mar. 22, 2013 From the State Intellectual Property Office of the People's Republic of China Re. Application No. 200880109464.9.
Desveaux et al. "Whirly Transcription Factors: Defense Gene Regulation and Beyond", Trends in Plant Science, TiPS, 10(2): 95-102, Feb. 2005.

(56) References Cited

OTHER PUBLICATIONS

Soderlund et al. "Sequencing, Mapping, and Analysis of 27,455 Maize Full-Length cDNAs", PLoS Genetics, 5(11): e1000740-1-e1000740-13, Nov. 2009.
Young et al. "Hypothetical Protein MTR_7g116270 [*Medicago truncatula*]", Database NCBI [Online], GenBank: AES82688.1, Database Accession No. AES82688, Nov. 21, 2011.
Zhang et al. "Phosphatidic Acid Regulates Microtubule Organization by Interaction With MAP65-1 in Response to Salt Stress in *Arabidopsis*", The Plant Cell, 24: 4555-4576, Nov. 2012.
Examination Report Dated May 23, 2013 From the Instituto Mexicano de la Propiedad Industrial Re. Application No. MX/a/2011/001741 and Its Translation Into English.
Invitation to Pay Additional Fees Dated Jul. 17, 2013 From the International Searching Authority Re. Application No. PCT/IB2013/054374.
Official Action Dated Jul. 26, 2013 From the US Patent and Trademark Office Re. U.S. Appl. No. 13/254,183.
Matsumoto et al. "Os11g0162200 [*Oryza sativa* Japonica Group]", Direct GenBank Sequence Submission, GenBank: BAF27672.1, GenBank Accession No. BAF27672, Aug. 11, 2012.
Communication Pursuant to Article 94(3) EPC Dated Aug. 2, 2013 From the European Patent Office Re. Application No. 10194223.3.
Examination Report Dated Jul. 9, 2013 From the Instituto Mexican de la Propiedad Industrial Re. Application No. MX/a/2010/007169 and Its Translation Into English.
Examination Report Dated Jun. 26, 2013 From the Instituto Mexicano de la Propiedad Industrial Re. Application No. MX/a/2010/000975 and Its Translation Into English.
Official Action Dated Aug. 12, 2013 From the US Patent and Trademark Office Re. U.S. Appl. No. 12/834,106.
Substantive Examination Report Dated Jul. 31, 2013 From the Intellectual Property Office of the Philippines, Bureau of Patents Re. Application No. 1/2009/501930.
International Preliminary Report on Patentability Dated Jul. 4, 2013 From the International Bureau of WIPO Re. Application No. PCT/IB2011/055854.
Communication Pursuant to Rules 70(2) and 70a(2) EPC Dated Mar. 5, 2013 From the European Patent Office Re. Application No. 10785834.2.
International Preliminary Report on Patentability Dated Feb. 21, 2013 From the International Bureau of WIPO Re. Application No. PCT/IB2011/051843.
Notice of Allowance Dated Jan. 7, 2013 From the US Patent and Trademark Office Re. U.S. Appl. No. 12/457,199.
Official Action Dated Feb. 8, 2013 From the US Patent and Trademark Office Re. U.S. Appl. No. 12/594,853.
Requisition by the Examiner Dated Feb. 12, 2013 From the Canadian Intellectual Property Office Re. Application No. 2,570,195.
Restriction Official Action Dated Mar. 1, 2013 From the US Patent and Trademark Office Re. U.S. Appl. No. 13/254,183.
Supplementary European Search Report and the European Search Opinion Dated Feb. 14, 2013 From the European Patent Office Re. Application No. 10785834.2.
Translation of Office Action Dated Jan. 17, 2013 From the State Intellectual Property Office of the People's Republic of China Re. Application No. 201110104274.1.
Translation of Office Action Dated Feb. 25, 2013 From the State Intellectual Property Office of the People's Republic of China Re. Application No. 200910217137.1.
Translation of Search Report Dated Jan. 17, 2013 From the State Intellectual Property Office of the People's Republic of China Re. Application No. 201110104274.1.
Examination Report Dated Dec. 7, 2012 From the Instituto Mexicano de la Propiedad Industrial Re. Application No. MX/a/2011/003575 and Its Translation Into English.
Patent Examination Report Dated Jan. 4, 2013 From the Australian Government, IP Australia Re. Application No. 2008344935.
Communication Pursuant to Article 94(3) EPC Dated May 29, 2013 From the European Patent Office Re. Application No. 09823171.5.
Examination Report Dated Mar. 13, 2013 From the Instituto Mexicano de la Propiedad Industrial Re. Application No. PA/a/2005/009380 and Its Summary in English.
Official Action Dated May 20, 2013 From the US Patent and Trademark Office Re. U.S. Appl. No. 13/059,231.
Official Action Dated Jun. 24, 2013 From the US Patent and Trademark Office Re. U.S. Appl. No. 12/992,902.
Patent Examination Report Dated Jun. 21, 2013 From the Australian Government, IP Australia Re. Application No. 2012241091.
Patent Examination Report Dated Jun. 27, 2013 From the Australian Government, IP Australia Re. Application No. 2012216482.
Patent Examination Report Dated May 31, 2013 From the Australian Government, TP Australia Re. Application No. 2008278654.
Requisition—Sequence Listing Dated May 8, 2013 From the Canadian Intellectual Property Office Re. Application No. 2,753,616.
*Arabidopsis* Genome Initiative "Analysis of the Genome Sequence of the Flowering Plant *Arabicopsis thaliana*" Nature, 408: 796-815, Dec. 14, 2000.
Ciddi et al. "Elicitation of *Taxus* SP. Cell Cultures for Production of Taxol", Biotechnology Letters, 17(12): 1343-1346, Dec. 1995.
Hirner et al. "*Arabidopsis* LHT1 Is a High-Affinity Transporter for Cellular Amino Acid Uptake in Both Root Epidermis and Leaf Mesophyll", The Plant Cell, 18: 1931-1946, Aug. 2006.
Kikuchi et al. "*Oryza sativa* Japonica Group cDNA Clone:J023131004, Full Insert Sequence", GenBank Database Accession No. AK072531, Jul. 2, 2013.
Lurin et al. "Genome-Wide Analysis of *Arabidopsis* Pentatricopeptide Repeat Proteins Reveals Their Essential Role in Organelle Biogenesis", The plant Cell, 16: 2089-2103, Aug. 2004.
Matz et al. "*Gossypium hirsutum* GHDEL65 (ghde165) mRNA, Complete CDS", GenBank Nucleotide, GenBank Accession No. AF336280, Mar. 15, 2001.
Plant Energy Biology "Protein_Coding: Cationic Amino Acid Transporter 2 (TAIR10)", Plant Energy Biology: SUBA3 Flatfile for AT1G58030.1, Database, 1 P., 2007.
Rolletschek et al. "Ectopic Expression of an Amino Acid Transporter (VfAAP1) in Seeds of Vica Narbonensis and Pea Increases Storage Proteins", Plant Physiology, 137: 1236-1249, Apr. 2005.
Su et al. "Molecular and Functional Characterization of a Family of Amino Acid Transporter From *Arabidopsis*", Plant Physiology, 136: 3104-3113, Oct. 2004.
TAIR "Encodes a Member of the Cationic Amino Acid Transporter (CAT) Subfamily of Amino Acid Polyamine Choline Transporters. Localized to the Tonoplast", TAIR, Locus: AT1G58030, TAIR Accession No. Locus:2196245, 4 P., 2013.
TAIR "Protein Kinase Superfamily Protein. Functions in: Protein Serine/Threonine Kinase Activity, Protein Kinase activity, Kinase Activity, ATP Binding ff.", TAIR, Locus: AT5G15080, TAIR Accession No. Locus:2147805, 4 P., 2013.
Terminology "Frequently Asked Questions", Bioinformatics Website, Frequently Asked Questions, 2001.
Theologis et al. "Sequence and Analysis off Chromosome 1 of the Plant *Arabidopsis thaliana*", Nature, 408: 816-820, Dec. 14, 2000.
Bennetzen et al. "*Setaria italica* Strain Yugu1 SETITScaffold_2_Cont751, Whole Genome Shotgun Sequence", Database NCBI [Online], GenBank Accession No. AGNK01000751, May 11, 2012.
Briggs et al. "Poly(ADP-Ribosyl)ation in Plants", Trends in Plant Science, 16(7): 372-380, Jul. 31, 2011. p. 378.
Liu et al. "Plant Full Length Insert Polypeptide Seqid 64542", Database Geneseq [Online], XP002713973, Retrieved From EBI Accession No. GSP:ADY08727, Database Accession No. ADY08727, Apr. 21, 2005. Polypeptide Has 96.4% Identity to SEQ ID No. 653 and Is Used for the Same Purpose, Abstract, Sequence.
Paterson et al. "SubName: Full=Putative Uncharacterized Protein Sb02g004350", Database UniProt [Online], XP002713972, Retrieved From EBI Accession No. UNIPROT:C5X1301, Database Accession No. C5X1301, Sep. 1, 2009. Polynucleotide and Polypeptide Molecules Fully Comprising the Present Molecules According to SEQ ID No. 166, 653, Abstract, Sequence.
Communication Pursuant to Article 94(3) EPC Dated Nov. 7, 2013 From the European Patent Office Re. Application No. 10748403.2.

(56) References Cited

OTHER PUBLICATIONS

Communication Pursuant to Rules 70(2) and 70a(2) EPC Dated Nov. 4, 2013 From the European Patent Office Re. Application No. 10840687.7.
Examination Report Dated Aug. 22, 2013 From the Instituto Mexicano de la Propiedad Industrial Re. Application No. MX/a/2011/009044 and Its Translation Into English.
Official Action Dated Oct. 29, 2013 From the US Patent and Trademark Office Re. U.S. Appl. No. 13/059,231.
Seki et al. "Monitoring the Expression Profiles of 7000 Arabidopsis Genes Under Drought, Cold and High-Salinity Stresses Using A Full-Length cDNA Microarray", The Plant Journal, 31(3): 279-292, 2002.
Tobias et al. "Structure of the Cinnamyl-Alcohol Dehydrogenase Gene Family in Rice and Promoter Activity of A Member Associated With Lignification", Planta, 220: 678-688, 2005.
Advisory Action Before the Filing of An Appeal Brief Dated Nov. 19, 2013 From the US Patent and Trademark Office Re. U.S. Appl. No. 12/834,106.
Advisory Action Before the Filing of An Appeal Brief Dated Dec. 20, 2013 From the US Patent and Trademark Office Re. U.S. Appl. No. 12/834,106.
Applicant-Initiated Interview Summary Dated Dec. 18, 2013 From the US Patent and Trademark Office Re. U.S. Appl. No. 12/834,106.
Applicant-Initiated Interview Summary Dated Nov. 20, 2013 From the US Patent and Trademark Office Re. U.S. Appl. No. 13/125,047.
Examination Report Dated Oct. 1, 2013 From the Instituto Mexicano de la Propiedad Industrial Re. Application No. MX/a/2010/000975 and Its Translation Into English.
Examination Report Dated Dec. 16, 2013 From the Government of India, Patent Office, Intellectual Property Building Re. Application No. 2570/CHENP/2008.
International Preliminary Report on Patentability Dated Nov. 14, 2013 From the International Bureau of WIPO Re. Application No. PCT/IL2012/050154.
International Search Report and the Written Opinion Dated Nov. 19, 2013 From the International Searching Authority Re. Application No. PCT/IL2013/050725.
Requisition by the Examiner Dated Oct. 28, 2013 From the Canadian Intellectual Property Office Re. Application No. 2,570,195.
Lazar et al. "Transforming Growth Factor Alpha: Mutation of Aspartic Acid 47 and Leucine 48 Results in Different Biological Activities", Molecular and Cell Biology, 8(3): 1247-1252, Mar. 1988.
Li et al. "Dehydration-Induced Protein RD22-Like Protein [Gossypium Hirsutum]", NCBI Database [Online], GenBank: AAL67991.1, GenBank Accession No. AAL67991, Dec. 4, 2002.
Yu et al. "Cell Cycle Checkpoint Protein MAD2 Homolog [Zea Mays]", Database NCBI [Online], GenBank: AAD30555.1, GenBank Accession No. AAD30555, May 17, 1999.
Communication Pursuant to Rule 58 EPCc or Rule 159 EPC, Invitation to Remedy Deficiencies in the Application Documents Dated Dec. 6, 2013 From the European Patent Office Re. Application No. 11190921.4.
Communication Pursuant to Article 94(3) EPC Dated Oct. 9, 2013 From the European Patent Office Re. Application No. 08869158.9.
Communication Pursuant to Article 94(3) EPC Dated Aug. 20, 2013 From the European Patent Office Re. Application No. 11172514.9.
International Search Report and the Written Opinion Dated Sep. 1, 2013 From the International Searching Authority Re. Application No. PCT/IB2013/054374.
Invitation to Pay Additional Fees Dated Oct. 16, 2013 From the International Searching Authority Re. Application No. PCT/IL2013/050725.
Office Action Dated Sep. 9, 2013 From the State Intellectual Property Office of the People's Republic of China Re. Application No. 200910217137.1 and Its Translation Into English.
Office Action Dated Oct. 28, 2013 From the State Intellectual Property Office of the People's Republic of China Re. Application No. 201110104274.1 and Its Translation Into English.
Official Action Dated Sep. 16, 2013 From the US Patent and Trademark Office Re. U.S. Appl. No. 13/125,047.
Supplementary European Search Report and the European Search Opinion Dated Oct. 15, 2013 From the European Patent Office Re. Application No. 10840687.7.
Translation of Office Action Dated Aug. 28, 2013 From the State Intellectual Property Office of the People's Republic of China Re. Application No. 200880109464.9.
Bennetzen et al. "Setaria Italica Strain Yugul SETITScaffold_2_Cont751, Whole Genome Shotgun Sequence", Database NCBI [Online], GenBank Accession No. AGNK01000751, May 11, 2012.
Briggs et al. "Poly(ADP-Ribosyl)ation in Plants", Trends in Plant Science, 16(7):372-380, Jul. 31, 2011. p. 378.
Clontech "Genome Walker™ Universal Kit User Manual", Clontech Laboratories Inc., Cat. No. 638904, PT3042-1 (PR742239), p. 1-30, Apr. 25, 2007.
Liu et al. "Plant Full Length Insert Polypeptide Seqid 64542", Database Geneseq [Online], XP002713973, Retrieved From EBI Accession No. GSP:ADY08727, Database Accession No. ADY08727, Apr. 21, 2005. Polypeptide Has 96.4% Identity to SEQ ID No:653 and Is Used for the Same Purpose, Abstract, Sequence.
NCBI "PREDICTED: Nudix Hydrolase 16, Mitochondrial-Like [Setaria Italica]", Database NCBI [Online], NCBI Reference Sequence: XP_004955808, Jun. 26, 2013.
Paterson et al. "Sorghum Bicolor Chromosome 2, Whole Genome Shotgun Sequence", NCBI Database [Online], Retrieved From EBI Accession No. EMBL:CM000761, Database Accession No. CM000761, Jun. 24, 2009. Sequence.
Paterson et al. "SubName: Full=Putative Uncharacterized Protein Sb02g004350", Database UniProt [Online], XP002713972, Retrieved From EBI Accession No. UNIPROT:C5X1301, Database Accession No. C5X1301, Sep. 1, 2009. Polynucleotide and Polypeptide Molecules Fully Comprising the Present Molecules According to SEQ ID No:166, 653, Abstract, Sequence.
Zhou et al. "Global Genome Expression Analysis of Rice in Response to Drought and High-Salinity Stresses in Shoot, Flag Leaf, and Panicle", Plant Molecular Biology, 63(5): 591-608, Mar. 2007.
Requisition by the Examiner Dated Aug. 27, 2013 From the Canadian Intellectual Property Office Re. Application No. 2,526,440.

* cited by examiner

POLYNUCLEOTIDES, POLYPEPTIDES ENCODED THEREBY, AND METHODS OF USING SAME FOR INCREASING ABIOTIC STRESS TOLERANCE AND/OR BIOMASS AND/OR YIELD IN PLANTS EXPRESSING SAME

RELATED APPLICATIONS

This Application is a National Phase of PCT Patent Application No. PCT/IL2008/001024 having International filing date of Jul. 24, 2008, which claims the benefit of U.S. Provisional Patent Application No. 60/935,046 filed on Jul. 24, 2007. The contents of the above Applications are all incorporated herein by reference.

FIELD AND BACKGROUND OF THE INVENTION

The present invention, in some embodiments thereof, relates to isolated polypeptides and polynucleotides and more particularly, but not exclusively, to methods of using same for increasing tolerance of a plant to abiotic stress, growth, biomass, vigor and/or yield of a plant.

Abiotic stress (ABS; also referred to as "environmental stress") conditions such as salinity, drought, flood, suboptimal temperature and toxic chemical pollution, cause substantial damage to agricultural plants. Most plants have evolved strategies to protect themselves against these conditions. However, if the severity and duration of the stress conditions are too great, the effects on plant development, growth and yield are profound. Furthermore, most of the crop plants are highly susceptible to ABS and thus necessitate optimal growth conditions for commercial crop yields. Continuous exposure to stress causes major alterations in plant's metabolism which ultimately leads to cell death and consequently yield loss. Thus, despite extensive research and intensive crop-protection measures, losses due to abiotic stress conditions remain in the billions of dollars annually.

Drought is a gradual phenomenon, which involves periods of abnormally dry weather that persists long enough to produce serious hydrologic imbalances such as crop damage and water supply shortage. In severe cases, drought can last many years and result in devastating effects on agriculture and water supplies. With burgeoning population and chronic shortage of available fresh water, drought is not only the number one weather-related problem in agriculture, but it also ranks as one of the major natural disasters of all time, causing not only economic damage (e.g., losses from the US drought of 1988 exceeded $40 billion), but also loss of human lives, as in the 1984-1985 drought in the Horn of Africa which led to a famine that killed 750,000 people. Furthermore, drought is associated with increase susceptibility to various diseases.

For most crop plants, the land regions of the world are too arid. In addition, overuse of available water results in increased loss of agriculturally-usable land (desertification), and increase of salt accumulation in soils adds to the loss of available water in soils.

Salinity, high salt levels, affects one in five hectares of irrigated land. This condition is only expected to worsen, further reducing the availability of arable land and crop production, since none of the top five food crops, i.e., wheat, corn, rice, potatoes, and soybean, can tolerate excessive salt. Detrimental effects of salt on plants result from both water deficit which leads to osmotic stress (similar to drought stress) and the effect of excess sodium ions on critical biochemical processes. As with freezing and drought, high salt causes water deficit; and the presence of high salt makes it difficult for plant roots to extract water from their environment. Soil salinity is thus one of the more important variables that determine whether a plant may thrive. In many parts of the world, sizable land areas are uncultivable due to naturally high soil salinity. Thus, salination of soils that are used for agricultural production is a significant and increasing problem in regions that rely heavily on agriculture, and is worsen by over-utilization, over-fertilization and water shortage, typically caused by climatic change and the demands of increasing population. Salt tolerance is of particular importance early in a plant's lifecycle, since evaporation from the soil surface causes upward water movement, and salt accumulates in the upper soil layer where the seeds are placed. On the other hand, germination normally takes place at a salt concentration which is higher than the mean salt level in the whole soil profile.

Germination of many crops is sensitive to temperature. A gene that would enhance germination in hot conditions would be useful for crops that are planted late in the season or in hot climates. In addition, seedlings and mature plants that are exposed to excess heat may experience heat shock, which may arise in various organs, including leaves and particularly fruit, when transpiration is insufficient to overcome heat stress. Heat also damages cellular structures, including organelles and cytoskeleton, and impairs membrane function. Heat shock may produce a decrease in overall protein synthesis, accompanied by expression of heat shock proteins, e.g., chaperones, which are involved in refolding proteins denatured by heat.

Heat stress often accompanies conditions of low water availability. Heat itself is seen as an interacting stress and adds to the detrimental effects caused by water deficit conditions. Water Evaporative demand exhibits near exponential increases with increases in daytime temperatures and can result in high transpiration rates and low plant water potentials. High-temperature damage to pollen almost always occurs in conjunction with drought stress, and rarely occurs under well-watered conditions. Combined stress can alter plant metabolism in novel ways; therefore understanding the interaction between different stresses may be important for the development of strategies to enhance stress tolerance by genetic manipulation.

Excessive chilling conditions, e.g., low, but above freezing, temperatures affect crops of tropical origins, such as soybean, rice, maize, and cotton. Typical chilling damage includes wilting, necrosis, chlorosis or leakage of ions from cell membranes. The underlying mechanisms of chilling sensitivity are not completely understood yet, but probably involve the level of membrane saturation and other physiological deficiencies. For example, photoinhibition of photosynthesis (disruption of photosynthesis due to high light intensities) often occurs under clear atmospheric conditions subsequent to cold late summer/autumn nights. In addition, chilling may lead to yield losses and lower product quality through the delayed ripening of maize.

Water deficit is a common component of many plant stresses. Water deficit occurs in plant cells when the whole plant transpiration rate exceeds the water uptake. In addition to drought, other stresses, such as salinity and low temperature, produce cellular dehydration.

Salt and drought stress signal transduction consist of ionic and osmotic homeostasis signaling pathways. The ionic aspect of salt stress is signaled via the SOS pathway where a calcium-responsive SOS3-SOS2 protein kinase complex controls the expression and activity of ion transporters such as SOS1. The osmotic component of salt stress involves complex plant reactions that overlap with drought and/or cold stress responses.

Common aspects of drought, cold and salt stress response [Reviewed in Xiong and Zhu (2002) Plant Cell Environ. 25: 131-139] include: (a) transient changes in the cytoplasmic calcium levels early in the signaling event [Knight, (2000) Int. Rev. Cytol. 195: 269-324; Sanders et al. (1999) Plant Cell 11: 691-706]; (b) signal transduction via mitogen-activated and/or calcium dependent protein kinases (CDPKs) and protein phosphatases [Merlot et al. (2001) Plant J. 25: 295-303; Tahtiharju and Palva (2001) Plant J. 26: 461-470]; (c) increases in abscisic acid levels in response to stress triggering a subset of responses; (d) inositol phosphates as signal molecules (at least for a subset of the stress responsive transcriptional changes [Xiong et al. (2001) Genes Dev. 15: 1971-1984]; (e) activation of phospholipases which in turn generates a diverse array of second messenger molecules, some of which might regulate the activity of stress responsive kinases [e.g., phospholipase D; Frank et al. (2000) Plant Cell 12: 111-124]; (f) induction of late embryogenesis abundant (LEA) type genes including the CRT/DRE responsive COR/RD genes; (g) increased levels of antioxidants and compatible osmolytes such as proline and soluble sugars [Hasegawa et al. (2000) Annu Rev. Plant Mol. Plant Physiol. 51: 463-499)]; and (h) accumulation of reactive oxygen species such as superoxide, hydrogen peroxide, and hydroxyl radicals.

Abscisic acid biosynthesis is regulated by osmotic stress at multiple steps. Both ABA-dependent and -independent osmotic stress signaling first modify constitutively expressed transcription factors, leading to the expression of early response transcriptional activators, which then activate downstream stress tolerance effector genes.

Several genes which increase tolerance to cold or salt stress can also improve drought stress protection, these include for example, the transcription factor AtCBF/DREB1, OsCDPK7 (Saijo et al. 2000, Plant J. 23: 319-327) or AVP1 (a vacuolar pyrophosphatase-proton pump, Gaxiola et al. 2001, Proc. Natl. Acad. Sci. USA 98: 11444-11449).

Developing stress-tolerant plants is a strategy that has the potential to solve or mediate at least some of these problems. However, traditional plant breeding strategies used to develop new lines of plants that exhibit tolerance to ABS are relatively inefficient since they are tedious, time consuming and of unpredictable outcome. Furthermore, limited germplasm resources for stress tolerance and incompatibility in crosses between distantly related plant species represent significant problems encountered in conventional breeding. Additionally, the cellular processes leading to ABS tolerance are complex in nature and involve multiple mechanisms of cellular adaptation and numerous metabolic pathways.

Genetic engineering efforts, aimed at conferring abiotic stress tolerance to transgenic crops, have been described in the art. Studies by Apse and Blumwald (Curr Opin Biotechnol. 13:146-150, 2002), Quesada et al. (Plant Physiol. 130: 951-963, 2002), Holmström et al. (Nature 379: 683-684, 1996), Xu et al. (Plant Physiol 110: 249-257, 1996), Pilon-Smits and Ebskamp (Plant Physiol 107: 125-130, 1995) and Tarczynski et al. (Science 259: 508-510, 1993) have all attempted at generating stress tolerant plants.

In addition, several U.S. patents and patent applications also describe polynucleotides associated with stress tolerance and their use in generating stress tolerant plants. U.S. Pat. Nos. 5,296,462 and 5,356,816 describe transforming plants with polynucleotides encoding proteins involved in cold adaptation in *Arabidopsis thaliana* for promoting cold tolerance.

U.S. Pat. No. 6,670,528 describes transforming plants with polynucleotides encoding polypeptides binding to stress responsive elements for promoting tolerance to abiotic stress.

U.S. Pat. No. 6,720,477 describes transforming plants with a polynucleotide encoding a signal transduction stress-related protein, capable of increasing tolerance of the transformed plants to abiotic stress.

U.S. application Ser. Nos. 09/938,842 and 10/342,224 describe abiotic stress-related genes and their use to confer upon plants tolerance to abiotic stress.

U.S. application Ser. No. 10/231,035 describes overexpressing a molybdenum cofactor sulfurase in plants for increasing tolerance to abiotic stress.

WO2004/104162 to Evogene Ltd. teaches polynucleotide sequences and methods of utilizing same for increasing the tolerance of a plant to abiotic stresses and/or increasing the biomass of a plant.

WO2007/020638 to Evogene Ltd. teaches polynucleotide sequences and methods of utilizing same for increasing the tolerance of a plant to abiotic stresses and/or increasing the biomass, vigor and/or yield of a plant.

WO2007/049275 to Evogene Ltd. teaches isolated polypeptides, polynucleotides encoding same for increasing tolerance of a plant to abiotic stress, and/or for increasing biomass, vigor and/or yield of a plant.

Additional background art includes U.S. Patent Appl. Nos. 20060183137A1 A1 and 20030056249A1.

SUMMARY OF THE INVENTION

According to an aspect of some embodiments of the present invention there is provided a method of increasing tolerance of a plant to abiotic stress, the method comprising expressing within the plant an exogenous polynucleotide encoding a polypeptide comprising an amino acid sequence at least 90% homologous to the amino acid sequence selected from the group consisting of SEQ ID NOs:201, 207, 212, 202-206, 208-211, 213-391, 1655, 961-1529, and 1660-1663, thereby increasing the tolerance of the plant to abiotic stress.

According to an aspect of some embodiments of the present invention there is provided a method of increasing tolerance of a plant to abiotic stress, the method comprising expressing within the plant an exogenous polynucleotide encoding a polypeptide comprising an amino acid sequence selected from the group consisting of SEQ ID NOs:201, 207, 212, 202-206, 208-211, 213-391, 1655, 961-1529, and 1660-1663, thereby increasing the tolerance of the plant to abiotic stress.

According to an aspect of some embodiments of the present invention there is provided a method of increasing biomass, growth rate, vigor and/or yield of a plant, the method comprising expressing within the plant an exogenous polynucleotide encoding a polypeptide comprising an amino acid sequence at least 90% homologous to the amino acid sequence selected from the group consisting of SEQ ID NOs: 201, 207, 212, 202-206, 208-211, 213-391, 1655, 961-1529, and 1660-1663, thereby increasing the biomass, growth rate, vigor and/or yield of the plant.

According to an aspect of some embodiments of the present invention there is provided a method of increasing biomass, growth rate, vigor and/or yield of a plant, the method comprising expressing within the plant an exogenous polynucleotide encoding a polypeptide comprising an amino acid sequence selected from the group consisting of SEQ ID NOs: 201, 207, 212, 202-206, 208-211, 213-391, 1655, 961-1529, and 1660-1663, thereby increasing the biomass, growth rate, vigor and/or yield of the plant.

According to an aspect of some embodiments of the present invention there is provided an isolated polynucleotide comprising a nucleic acid sequence at least 90% identical to the nucleic acid sequence selected from the group consisting of SEQ ID NOs:1530, 1561, 1532, 1531, 1562, 1533, 1538, 1549, 1665, 1566, 1554, 1563, 1557, 1564, 1534, 1536, 1552, 1553, 1666, 1547, 1548, 1556, 1559, 1560, 1654, 1555, 1540, 1543, 1668, 1539, 1550, 1558, 1565, 1541, 1667, 1542, 1544, 1537, 1551, 1545, 1-200, 1653, 392-960, and 1656-1659.

According to an aspect of some embodiments of the present invention there is provided an isolated polynucleotide comprising a nucleic acid sequence selected from the group consisting of SEQ ID NOs:1530, 1561, 1532, 1531, 1562, 1533, 1538, 1549, 1665, 1566, 1554, 1563, 1557, 1564, 1534, 1536, 1552, 1553, 1666, 1547, 1548, 1556, 1559, 1560, 1654, 1555, 1540, 1543, 1668, 1539, 1550, 1558, 1565, 1541, 1667, 1542, 1544, 1537, 1551, 1545, 1-200, 1653, 392-960, and 1656-1659.

According to an aspect of some embodiments of the present invention there is provided a nucleic acid construct comprising the isolated polynucleotide and a promoter for directing transcription of the nucleic acid sequence.

According to an aspect of some embodiments of the present invention there is provided an isolated polypeptide, comprising an amino acid sequence at least 90% homologous to the amino acid sequence selected from the group consisting of SEQ ID NOs:201, 207, 212, 202-206, 208-211, 213-391, 1655, 961-1529, and 1660-1663.

According to an aspect of some embodiments of the present invention there is provided an isolated polypeptide, comprising an amino acid sequence selected from the group consisting of SEQ ID NOs:201, 207, 212, 202-206, 208-211, 213-391, 1655, 961-1529, and 1660-1663.

According to an aspect of some embodiments of the present invention there is provided a plant cell comprising an exogenous polypeptide comprising an amino acid sequence at least 90% homologous to the amino acid sequence selected from the group consisting of SEQ ID NOs:201, 207, 212, 202-206, 208-211, 213-391, 1655, 961-1529, and 1660-1663.

According to an aspect of some embodiments of the present invention there is provided a plant cell comprising an exogenous polypeptide comprising an amino acid sequence selected from the group consisting of SEQ ID NOs:201, 207, 212, 202-206, 208-211, 213-391, 1655, 961-1529, and 1660-1663.

According to an aspect of some embodiments of the present invention there is provided a plant cell comprising an exogenous polynucleotide comprising a nucleic acid sequence at least 90% homologous to the nucleic acid sequence selected from the group consisting of SEQ ID NOs: 1530, 1561, 1532, 1531, 1562, 1533, 1538, 1549, 1665, 1566, 1554, 1563, 1557, 1564, 1534, 1536, 1552, 1553, 1666, 1547, 1548, 1556, 1559, 1560, 1654, 1555, 1540, 1543, 1668, 1539, 1550, 1558, 1565, 1541, 1667, 1542, 1544, 1537, 1551, 1545, 1-200, 1653, 392-960, and 1656-1659.

According to an aspect of some embodiments of the present invention there is provided a plant cell comprising an exogenous polynucleotide comprising a nucleic acid sequence selected from the group consisting of SEQ ID NOs: 1530, 1561, 1532, 1531, 1562, 1533, 1538, 1549, 1665, 1566, 1554, 1563, 1557, 1564, 1534, 1536, 1552, 1553, 1666, 1547, 1548, 1556, 1559, 1560, 1654, 1555, 1540, 1543, 1668, 1539, 1550, 1558, 1565, 1541, 1667, 1542, 1544, 1537, 1551, 1545, 1-200, 1653, 392-960, and 1656-1659.

According to some embodiments of the invention, the nucleic acid sequence is selected from the group consisting of SEQ ID NOs:1530, 1561, 1532, 1531, 1562, 1533, 1538, 1549, 1665, 1566, 1554, 1563, 1557, 1564, 1534, 1536, 1552, 1553, 1666, 1547, 1548, 1556, 1559, 1560, 1654, 1555, 1540, 1543, 1668, 1539, 1550, 1558, 1565, 1541, 1667, 1542, 1544, 1537, 1551, 1545, 1-200, 1653, 392-960, and 1656-1659.

According to some embodiments of the invention, the polynucleotide is selected from the group consisting of SEQ ID NOs:1530, 1561, 1532, 1531, 1562, 1533, 1538, 1549, 1665, 1566, 1554, 1563, 1557, 1564, 1534, 1536, 1552, 1553, 1666, 1547, 1548, 1556, 1559, 1560, 1654, 1555, 1540, 1543, 1668, 1539, 1550, 1558, 1565, 1541, 1667, 1542, 1544, 1537, 1551, 1545, 1-200, 1653, 392-960, and 1656-1659.

According to some embodiments of the invention, the amino acid sequence is selected from the group consisting of SEQ ID NOs:201, 207, 212, 202-206, 208-211, 213-391, 1655, 961-1529, and 1660-1663.

According to some embodiments of the invention, the polypeptide is selected from the group consisting of SEQ ID NOs:201, 207, 212, 202-206, 208-211, 213-391, 1655, 961-1529, and 1660-1663.

According to some embodiments of the invention, the plant cell forms a part of a plant.

According to some embodiments of the invention, the abiotic stress is selected from the group consisting of salinity, drought, water deprivation, low temperature, high temperature, heavy metal toxicity, anaerobiosis, nutrient deficiency, nutrient excess, atmospheric pollution and UV irradiation.

According to some embodiments of the invention, the method further comprising growing the plant expressing the exogenous polynucleotide under the abiotic stress.

Unless otherwise defined, all technical and/or scientific terms used herein have the same meaning as commonly understood by one of ordinary skill in the art to which the invention pertains. Although methods and materials similar or equivalent to those described herein can be used in the practice or testing of embodiments of the invention, exemplary methods and/or materials are described below. In case of conflict, the patent specification, including definitions, will control. In addition, the materials, methods, and examples are illustrative only and are not intended to be necessarily limiting.

BRIEF DESCRIPTION OF THE DRAWINGS

The patent or application file contains at least one drawing executed in color. Copies of this patent or patent application publication with color drawing(s) will be provided by the Office upon request and payment of the necessary fee.

Some embodiments of the invention are herein described, by way of example only, with reference to the accompanying drawings. With specific reference now to the drawings in detail, it is stressed that the particulars shown are by way of example and for purposes of illustrative discussion of embodiments of the invention. In this regard, the description taken with the drawings makes apparent to those skilled in the art how embodiments of the invention may be practiced.

In the drawings:

Figure 1:
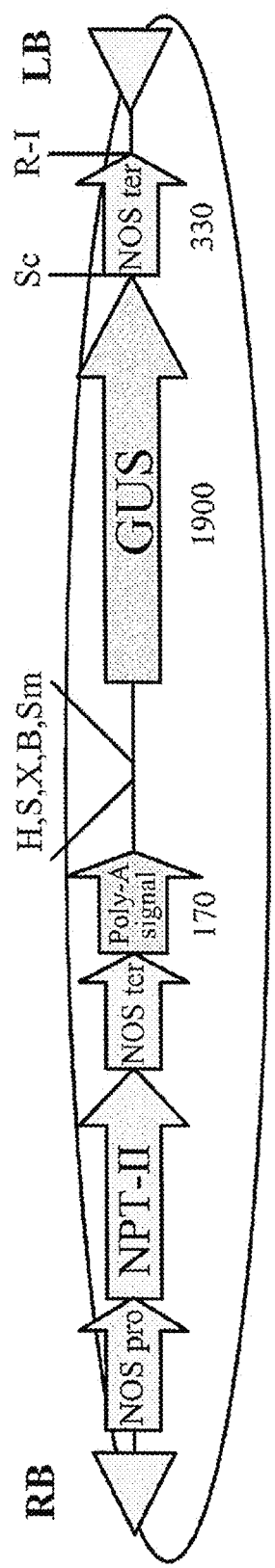

FIG. 1 is a schematic illustration of the pGI binary plasmid used for expressing the isolated polynucleotide sequences of the invention. RB—T-DNA right border; LB—T-DNA left border; H—HindIII restriction enzyme; X—XbaI restriction enzyme; B—BamHI restriction enzyme; S—SalI restriction enzyme; Sm—SmaI restriction enzyme; R-I—EcoRI restriction enzyme; Sc—SacI/SstI/Ecl136II; (numbers)—Length in base-pairs; NOS pro=nopaline synthase promoter; NPT- II=neomycin phosphotransferase gene; NOS ter=nopaline synthase terminator; Poly-A signal (polyadenylation signal); GUSintron—the GUS reporter gene (coding sequence and intron) The isolated polynucleotide sequences of the invention were cloned into the vector while replacing the GUSintron reporter gene.

Figure 2B:
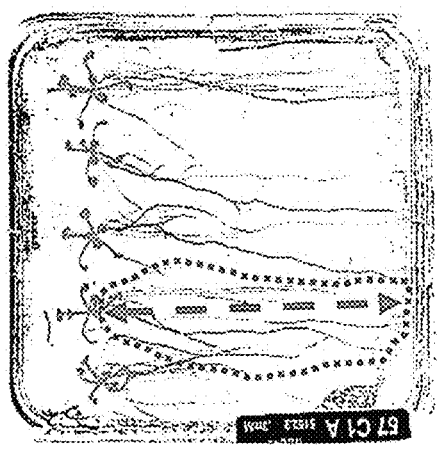
Figure 2A:
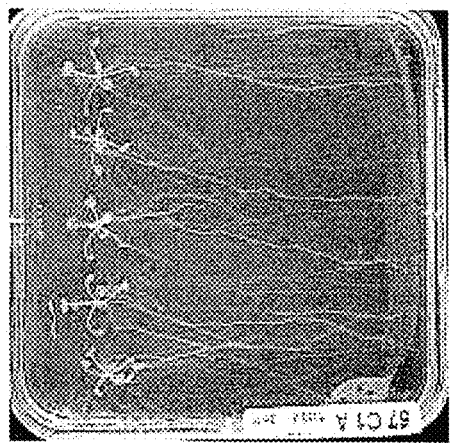

FIGS. 2a-b are images depicting visualization of root development of plants grown in transparent agar plates. The different transgenes were grown in transparent agar plates for 17 days and the plates were photographed every 2 days starting at day 7. FIG. 2a—An image of a photograph of plants taken following 12 days on agar plates. FIG. 2b—An image of root analysis in which the length of the root measured is represented by a red arrow.

DESCRIPTION OF SPECIFIC EMBODIMENTS OF THE INVENTION

The present invention, in some embodiments thereof, relates to isolated polypeptides and polynucleotides encoding same, and more particularly, but not exclusively, to methods of using same for increasing tolerance to abiotic stress, growth rate, yield, biomass and/or vigor of a plant.

Before explaining at least one embodiment of the invention in detail, it is to be understood that the invention is not necessarily limited in its application to the details set forth in the following description or exemplified by the Examples. The invention is capable of other embodiments or of being practiced or carried out in various ways.

While reducing the invention to practice, the present inventors have identified novel polypeptides and polynucleotides which can be used to increase tolerance to abiotic stress, and improve growth rate, biomass, yield and/or vigor of a plant.

Thus, as shown in the Examples section which follows, the present inventors have employed a bioinformatics approach which combines clustering and assembly of sequences from databases of the *Arabidopsis*, rice and other publicly available plant genomes, expressed sequence tags (ESTs), protein and pathway databases and QTL information with a digital expression profile ("electronic Northern Blot") and identified polynucleotides and polypeptides which can increase tolerance to abiotic stress, and improve growth, biomass, yield and vigor (SEQ ID NOs:1-200 and 1653 for polynucleotides; SEQ ID NOs:201-391 and 1655 for polypeptides; Table 1, Example 1). Putative ABST orthologs from monocot species were identified by alignments of ortholog sequences and digital expression profiles (SEQ ID NOs:392-960, 1656-1659 for polynucleotides; SEQ ID NOs:961-1529, 1660-1663 for polypeptides; Table 2, Example 1). As is further described in Tables 3 and 4 of the Examples section which follows, representative polynucleotides were cloned (polynucleotide SEQ ID NOs:1530, 1538, 1532, 1549, 1665, 1566, 1554, 1563, 1557, 1561, 1564, 1534, 1536, 1552, 1553, 1666, 1547, 1548, 1556, 1559, 1560, 1654, 1555, 1540, 1543 and 1668). Additional polynucleotides having optimized nucleic acid sequences were prepared (polynucleotide SEQ ID NOs:1531, 1539, 1533, 1550, 1558, 1562, 1565, 1541, 1667, 1542, 1544, 1537, 1551 and 1545). As is further described in the Examples section which follows, transgenic plants exogenously expressing the cloned and/or optimized polynucleotides of the invention were generated. As shown in Tables 5-76, these plants exhibit increased seedling weight, root coverage, root length, and relative growth rate when grown under osmotic stress (in the presence of 25% PEG), nitrogen deficiency (in the presence of 0.75 mM Nitrogen) or regular conditions. In addition, as shown in Tables 77-188, plants exogenously expressing the polynucleotides of the invention exhibit increased rosette area, rosette diameter, leaf average area, relative growth rate of the above, plants biomass, plant seed yield, 1000 seed weight, and harvest index when grown under salinity stress or normal conditions. Altogether, these results suggest the use of the novel polynucleotides and polypeptides of the invention for increasing abiotic stress tolerance, and improving growth rate biomass, vigor and/or yield of a plant.

Thus, according to one aspect of the invention, there is provided a method of increasing abiotic stress tolerance, growth rate, biomass, yield and/or vigor of a plant. The method is effected by expressing within the plant an exogenous polynucleotide encoding a polypeptide comprising an amino acid sequence at least 60% homologous to the amino acid sequence selected from the group consisting of SEQ ID NOs:201, 207, 212, 202-206, 208-211, 213-391, 1655, 961-1529, and 1660-1663.

The phrase "abiotic stress" as used herein refers to any adverse effect on metabolism, growth, reproduction and/or viability of a plant. Accordingly, abiotic stress can be induced by suboptimal environmental growth conditions such as, for example, salinity, water deprivation, water deficit, drought, flooding, freezing, low or high temperature (e.g., chilling or excessive heat), toxic chemical pollution, heavy metal toxicity, anaerobiosis, nutrient deficiency, nutrient excess, atmospheric pollution or UV irradiation. The implications of abiotic stress are discussed in the Background section.

The phrase "abiotic stress tolerance" as used herein refers to the ability of a plant to endure an abiotic stress without suffering a substantial alteration in metabolism, growth, productivity and/or viability.

As used herein the phrase "plant biomass" refers to the amount (measured in grams of air-dry or dry tissue) of a tissue produced from the plant in a growing season, which could also determine or affect the plant yield or the yield per growing area.

As used herein the phrase "plant yield" refers to the amount (as determined by weight, volume or size) or quantity (numbers) of tissue produced or harvested per plant or per growing season. Hence increased yield could affect the economic benefit one can obtain from the plant in a certain growing area and/or growing time.

As used herein the phrase "plant vigor" refers to the amount (measured by weight) of tissue produced by the plant in a given time. Hence increase vigor could determine or affect the plant yield or the yield per growing time or growing area.

As used herein the term "increasing" refers to at least about 2%, at least about 3%, at least about 4%, at least about 5%, at least about 10%, at least about 15%, at least about 20%, at least about 30%, at least about 40%, at least about 50%, at least about 60%, at least about 70%, at least about 80% or greater increase in plant abiotic stress tolerance, growth, biomass, yield and/or vigor as compared to a native plant [i.e., a plant not modified with the biomolecules (polynucleotide or polypeptides) of the invention, e.g., a non-transformed plant of the same species which is grown under the same growth conditions).

As used herein, the phrase "exogenous polynucleotide" refers to a heterologous nucleic acid sequence which may not be naturally expressed within the plant or which overexpression in the plant is desired. The exogenous polynucleotide may be introduced into the plant in a stable or transient manner, so as to produce a ribonucleic acid (RNA) molecule and/or a polypeptide molecule. It should be noted that the exogenous polynucleotide may comprise a nucleic acid sequence which is identical or partially homologous to an endogenous nucleic acid sequence of the plant.

As mentioned, the exogenous polynucleotide of the invention encodes a polypeptide having an amino acid sequence at least about 60%, at least about 65%, at least about 70%, at least about 75%, at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous to the amino acid sequence selected from the group consisting of SEQ ID NOs:201, 207, 212, 202-206, 208-211, 213-391, 1655, 961-1529, and 1660-1663.

Homology (e.g., percent homology) can be determined using any homology comparison software, including for example, the BlastP or TBLASTN software of the National Center of Biotechnology Information (NCBI) Version 2.2.16 [Mar. 25, 2007] such as by using default parameters, when starting from a polypeptide sequence; or the tBLASTX algorithm (available via the NCBI) such as by using default parameters, which compares the six-frame conceptual translation products of a nucleotide query sequence (both strands) against a protein sequence database. Default parameters of blastall 2.2.16 arguments: –p Program Name [String]; –d Database [String]; default=nr; –i Query File [File In]; default=stdin; –e Expectation value (E) [Real]; default=10.0; –m alignment view options; 0=pairwise; 1=query-anchored showing identities 2=query-anchored no identities; 3=flat query-anchored, show identities; 4=flat query-anchored, no identities; 5=query-anchored no identities and blunt ends; 6=flat query-anchored, no identities and blunt ends; 7=XML Blast output; 8=tabular; 9 tabular with comment lines; 10 ASN, text; 11 ASN, binary [Integer]; default=0; range from 0 to 11; –o BLAST report Output File [File Out] Optional; default=stdout; –F Filter query sequence (DUST with blastn, SEG with others) [String]; default=T; –G Cost to open a gap (–1 invokes default behavior) [Integer]; default=–1; –E Cost to extend a gap (–1 invokes default behavior) [Integer]; default=–1; –X X dropoff value for gapped alignment (in bits) (zero invokes default behavior); blastn 30, megablast 20, tblastx 0, all others 15 [Integer]; default=0; –I Show GPs in deflines [T/F]; default=F; –q Penalty for a nucleotide mismatch (blastn only) [Integer]; default=–3; –r Reward for a nucleotide match (blastn only) [Integer]; default=1; –v Number of database sequences to show one-line descriptions for (V) [Integer]; default=500; –b Number of database sequence to show alignments for (B) [Integer]; default=250; –f Threshold for extending hits, default if zero; blastp 11, blastn 0, blastx 12, tblastn 13; tblastx 13, megablast 0 [Real]; default=0; –g Perform gapped alignment (not available with tblastx) [T/F]; default=T; –Q Query Genetic code to use [Integer]; default=1; –D DB Genetic code (for tblast[nx] only) [Integer]; default=1; –a Number of processors to use [Integer]; default=1; –O SeqAlign file [File Out] Optional; –J Believe the query defline [T/F]; default=F; –M Matrix [String]; default=BLOSUM62; –W Word size, default if zero (blastn 11, megablast 28, all others 3) [Integer]; default=0; –z Effective length of the database (use zero for the real size) [Real]; default=0; –K Number of best hits from a region to keep (off by default, if used a value of 100 is recommended) [Integer]; default=0; –P 0 for multiple hit, 1 for single hit (does not apply to blastn) [Integer]; default=0; –Y Effective length of the search space (use zero for the real size) [Real]; default=0; –S Query strands to search against database (for blast[nx], and tblastx); 3 is both, 1 is top, 2 is bottom [Integer]; default=3; –T Produce HTML output [T/F]; default=F; –l Restrict search of database to list of GI's [String] Optional; –U Use lower case filtering of FASTA sequence [T/F] Optional; –y X dropoff value for ungapped extensions in bits (0.0 invokes default behavior); blastn 20, megablast 10, all others 7 [Real]; default=0.0; –Z X dropoff value for final gapped alignment in bits (0.0 invokes default behavior); blastn/megablast 50, tblastx 0, all others 25 [Integer]; default=0; –R PSI-TBLASTN checkpoint file [File In] Optional; –n MegaBlast search [T/F]; default=F; –L Location on query sequence [String] Optional; –A Multiple Hits window size, default if zero (blastn/megablast 0, all others 40 [Integer]; default=0; –w Frame shift penalty (OOF algorithm for blastx) [Integer]; default=0; –t Length of the largest intron allowed in a translated nucleotide sequence when linking multiple distinct alignments. (0 invokes default behavior; a negative value disables linking.) [Integer]; default=0; –B Number of concatenated queries, for blastn and tblastn [Integer] Optional; default=0; –V Force use of the legacy BLAST engine [T/F] Optional; default=F; –C Use composition-based statistics for blastpgp or tblastn; As first character; D or d: default (equivalent to F); 0 or F or f: no composition-based statistics; 1 or T or t: Composition-based statistics as in NAR 29:2994-3005, 2001; 2: Composition-based score adjustment as in Bioinformatics 21:902-911; 2005, conditioned on sequence properties; 3: Composition-based score adjustment as in Bioinformatics 21:902-911; 2005, unconditionally; For programs other than tblastn, must either be absent or be D, F or 0. As second character, if first character is equivalent to 1, 2, or 3; U or u: unified p-value combining alignment p-value and compositional p-value in round 1 only; [String]; default=D; –s Compute locally optimal Smith-Waterman alignments (This option is only; available for gapped tblastn.) [T/F]; default=F.

Homologous sequences include both orthologous and paralogous sequences. The term "paralogous" relates to gene-duplications within the genome of a species leading to paralogous genes. The term "orthologous" relates to homologous genes in different organisms due to ancestral relationship.

One option to identify orthologues in monocot plant species is by performing a reciprocal blast search. This may be done by a first blast involving blasting the sequence-of-interest against any sequence database, such as the publicly available NCBI database which may be found at: Hypertext Transfer Protocol://World Wide Web (dot) ncbi (dot) nlm (dot) nih (dot) gov. If orthologues in rice were sought, the sequence-of-interest would be blasted against, for example, the 28,469 full-length cDNA clones from Oryza sativa Nipponbare available at NCBI. The blast results may be filtered. The full-length sequences of either the filtered results or the non-filtered results are then blasted back (second blast) against the sequences of the organism from which the sequence-of-interest is derived. The results of the first and second blasts are then compared. An orthologue is identified when the sequence resulting in the highest score (best hit) in the first blast identifies in the second blast the query sequence (the original sequence-of-interest) as the best hit. Using the same rational a paralogue (homolog to a gene in the same organism) is found. In case of large sequence families, the ClustalW program may be used [Hypertext Transfer Protocol://World Wide Web (dot) ebi (dot) ac (dot) uk/Tools/clustalw2/index (dot) html], followed by a neighbor joining tree (Hypertext Transfer Protocol://en (dot) wikipedia (dot) org/wiki/Neighbor-joining) which helps visualizing the clustering.

According to some embodiments of the invention, the exogenous polynucleotide encodes a polypeptide consisting of the amino acid sequence set forth by SEQ ID NO:201, 207, 212, 202-206, 208-211, 213-391, 1655, 961-1529, 1660-1662 or 1663.

According to some embodiments of the invention the exogenous polynucleotide comprises a nucleic acid sequence which is at least about 60%, at least about 65%, at least about 70%, at least about 75%, at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the nucleic acid sequence selected from the group consisting of SEQ ID NOs:1530, 1561, 1532, 1531, 1562, 1533, 1538, 1549, 1665, 1566, 1554, 1563, 1557, 1564, 1534, 1536, 1552, 1553, 1666, 1547, 1548, 1556, 1559, 1560, 1654, 1555, 1540, 1543, 1668, 1539, 1550, 1558, 1565, 1541, 1667, 1542, 1544, 1537, 1551, 1545, 1-200, 1653, 392-960, and 1656-1659.

Identity (e.g., percent homology) can be determined using any homology comparison software, including for example, the BlastN software of the National Center of Biotechnology Information (NCBI) such as by using default parameters.

According to some embodiments of the invention the exogenous polynucleotide is at least about 60%, at least about 65%, at least about 70%, at least about 75%, at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polynucleotide selected from the group consisting of SEQ ID NOs:1530, 1561, 1532, 1531, 1562, 1533, 1538, 1549, 1665, 1566, 1554, 1563, 1557, 1564, 1534, 1536, 1552, 1553, 1666, 1547, 1548, 1556, 1559, 1560, 1654, 1555, 1540, 1543, 1668, 1539, 1550, 1558, 1565, 1541, 1667, 1542, 1544, 1537, 1551, 1545, 1-200, 1653, 392-960, and 1656-1659.

According to some embodiments of the invention the exogenous polynucleotide is set forth by SEQ ID NO:1530, 1561, 1532, 1531, 1562, 1533, 1538, 1549, 1665, 1566, 1554, 1563, 1557, 1564, 1534, 1536, 1552, 1553, 1666, 1547, 1548, 1556, 1559, 1560, 1654, 1555, 1540, 1543, 1668, 1539, 1550, 1558, 1565, 1541, 1667, 1542, 1544, 1537, 1551, 1545, 1-200, 1653, 392-960, and 1656-1658 or 1659.

As used herein the term "polynucleotide" refers to a single or double stranded nucleic acid sequence which is isolated and provided in the form of an RNA sequence, a complementary polynucleotide sequence (cDNA), a genomic polynucleotide sequence and/or a composite polynucleotide sequences (e.g., a combination of the above).

As used herein the phrase "complementary polynucleotide sequence" refers to a sequence, which results from reverse transcription of messenger RNA using a reverse transcriptase or any other RNA dependent DNA polymerase. Such a sequence can be subsequently amplified in vivo or in vitro using a DNA dependent DNA polymerase.

As used herein the phrase "genomic polynucleotide sequence" refers to a sequence derived (identified or isolated) from a chromosome and thus it represents a contiguous portion of a chromosome.

As used herein the phrase "composite polynucleotide sequence" refers to a sequence, which is at least partially complementary and at least partially genomic. A composite sequence can include some exonal sequences required to encode the polypeptide of the present invention, as well as some intronic sequences interposing therebetween. The intronic sequences can be of any source, including of other genes, and typically will include conserved splicing signal sequences. Such intronic sequences may further include cis acting expression regulatory elements.

Nucleic acid sequences encoding the polypeptides of the present invention may be optimized for expression. A non-limiting example of an optimized nucleic acid sequence is provided in SEQ ID NO:1531, which encodes the polypeptide comprising the amino acid sequence set forth by SEQ ID NO:201. Examples of such sequence modifications include, but are not limited to, an altered G/C content to more closely approach that typically found in the plant species of interest, and the removal of codons atypically found in the plant species commonly referred to as codon optimization.

The phrase "codon optimization" refers to the selection of appropriate DNA nucleotides for use within a structural gene or fragment thereof that approaches codon usage within the plant of interest. Therefore, an optimized gene or nucleic acid sequence refers to a gene in which the nucleotide sequence of a native or naturally occurring gene has been modified in order to utilize statistically-preferred or statistically-favored codons within the plant. The nucleotide sequence typically is examined at the DNA level and the coding region optimized for expression in the plant species determined using any suitable procedure, for example as described in Sardana et al. (1996, Plant Cell Reports 15:677-681). In this method, the standard deviation of codon usage, a measure of codon usage bias, may be calculated by first finding the squared proportional deviation of usage of each codon of the native gene relative to that of highly expressed plant genes, followed by a calculation of the average squared deviation. The formula used is: 1 SDCU=n=1 N [(Xn−Yn)/Yn]2/N, where Xn refers to the frequency of usage of codon n in highly expressed plant genes, where Yn to the frequency of usage of codon n in the gene of interest and N refers to the total number of codons in the gene of interest. A Table of codon usage from highly expressed genes of dicotyledonous plants is compiled using the data of Murray et al. (1989, Nuc Acids Res. 17:477-498).

One method of optimizing the nucleic acid sequence in accordance with the preferred codon usage for a particular plant cell type is based on the direct use, without performing any extra statistical calculations, of codon optimization Tables such as those provided on-line at the Codon Usage Database through the NIAS (National Institute of Agrobiological Sciences) DNA bank in Japan (Hypertext Transfer Protocol://World Wide Web (dot) kazusa (dot) or (dot) jp/codon/). The Codon Usage Database contains codon usage Tables for a number of different species, with each codon usage Table having been statistically determined based on the data present in Genbank.

By using the above Tables to determine the most preferred or most favored codons for each amino acid in a particular species (for example, rice), a naturally-occurring nucleotide sequence encoding a protein of interest can be codon optimized for that particular plant species. This is effected by replacing codons that may have a low statistical incidence in the particular species genome with corresponding codons, in regard to an amino acid, that are statistically more favored. However, one or more less-favored codons may be selected to delete existing restriction sites, to create new ones at potentially useful junctions (5' and 3' ends to add signal peptide or termination cassettes, internal sites that might be used to cut and splice segments together to produce a correct full-length sequence), or to eliminate nucleotide sequences that may negatively effect mRNA stability or expression.

The naturally-occurring encoding nucleotide sequence may already, in advance of any modification, contain a number of codons that correspond to a statistically-favored codon in a particular plant species. Therefore, codon optimization of the native nucleotide sequence may comprise determining which codons, within the native nucleotide sequence, are not statistically-favored with regards to a particular plant, and modifying these codons in accordance with a codon usage table of the particular plant to produce a codon optimized derivative. A modified nucleotide sequence may be fully or partially optimized for plant codon usage provided that the protein encoded by the modified nucleotide sequence is produced at a level higher than the protein encoded by the corresponding naturally occurring or native gene. Construction of synthetic genes by altering the codon usage is described in for example PCT Patent Application 93/07278.

Thus, the invention encompasses nucleic acid sequences described hereinabove; fragments thereof, sequences hybridizable therewith, sequences homologous thereto, sequences encoding similar polypeptides with different codon usage, altered sequences characterized by mutations, such as deletion, insertion or substitution of one or more nucleotides, either naturally occurring or man induced, either randomly or in a targeted fashion.

The invention provides an isolated polypeptide having an amino acid sequence at least about 60%, at least about 65%, at least about 70%, at least about 75%, at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, or more say 100% homologous to an amino acid sequence selected from the group consisting of SEQ ID NO:201, 207, 212, 202-206, 208-211, 213-391, 1655, 961-1529, and 1660-1663.

According to some embodiments of the invention, the polypeptide is set forth by SEQ ID NO:201, 207, 212, 202-206, 208-211, 213-391, 1655, 961-1529, and 1660-1662 or 1663.

The invention also encompasses fragments of the above described polypeptides and polypeptides having mutations, such as deletions, insertions or substitutions of one or more amino acids, either naturally occurring or man induced, either randomly or in a targeted fashion.

The term "plant" as used herein encompasses whole plants, ancestors and progeny of the plants and plant parts, including seeds, shoots, stems, roots (including tubers), and plant cells, tissues and organs. The plant may be in any form including suspension cultures, embryos, meristematic regions, callus tissue, leaves, gametophytes, sporophytes, pollen, and microspores. Plants that are particularly useful in the methods of the invention include all plants which belong to the superfamily Viridiplantae, in particular monocotyledonous and dicotyledonous plants including a fodder or forage legume, ornamental plant, food crop, tree, or shrub selected from the list comprising *Acacia* spp., *Acer* spp., *Actinidia* spp., *Aesculus* spp., *Agathis australis*, *Albizia amara*, *Alsophila tricolor*, *Andropogon* spp., *Arachis* spp, *Areca catechu*, *Astelia fragrans*, *Astragalus cicer*, *Baikiaea plurijuga*, *Betula* spp., *Brassica* spp., *Bruguiera gymnorrhiza*, *Burkea africana*, *Butea frondosa*, *Cadaba farinosa*, *Calliandra* spp, *Camellia sinensis*, *Canna indica*, *Capsicum* spp., *Cassia* spp., *Centroema pubescens*, *Chacoomeles* spp., *Cinnamomum cassia*, *Coffea arabica*, *Colophospermum mopane*, *Coronillia varia*, *Cotoneaster serotina*, *Crataegus* spp., *Cucumis* spp., *Cupressus* spp., *Cyathea dealbata*, *Cydonia oblonga*, *Cryptomeria japonica*, *Cymbopogon* spp., *Cynthea dealbata*, *Cydonia oblonga*, *Dalbergia monetaria*, *Davallia divaricata*, *Desmodium* spp., *Dicksonia squarosa*, *Dibeteropogon amplectens*, *Dioclea* spp, *Dolichos* spp., *Dorycnium rectum*, *Echinochloa pyramidalis*, *Ehraffia* spp., *Eleusine coracana*, *Eragrestis* spp., *Erythrina* spp., *Eucalypfus* spp., *Euclea schimperi*, *Eulalia vi/losa*, *Pagopyrum* spp., *Feijoa sellowlana*, *Fragaria* spp., *Flemingia* spp, *Freycinetia banksli*, *Geranium thunbergii*, *GinAgo biloba*, *Glycine javanica*, *Gliricidia* spp, *Gossypium hirsutum*, *Grevillea* spp., *Guibourtia coleosperma*, *Hedysarum* spp., *Hemaffhia altissima*, *Heteropogon contoffus*, *Hordeum vulgare*, *Hyparrhenia rufa*, *Hypericum erectum*, *Hypeffhelia dissolute*, *Indigo incamata*, *Iris* spp., *Leptarrhena pyrolifolia*, *Lespediza* spp., *Lettuca* spp., *Leucaena leucocephala*, *Loudetia simplex*, *Lotonus bainesli*, *Lotus* spp., *Macrotyloma axillare*, *Malus* spp., *Manihot esculenta*, *Medicago saliva*, *Metasequoia glyptostroboides*, *Musa sapientum*, *Nicotianum* spp., *Onobrychis* spp., *Ornithopus* spp., *Oryza* spp., *Peltophorum africanum*, *Pennisetum* spp., *Persea gratissima*, *Petunia* spp., *Phaseolus* spp., *Phoenix canariensis*, *Phormium cookianum*, *Photinia* spp., *Picea glauca*, *Pinus* spp., *Pisum sativam*, *Podocarpus totara*, *Pogonarthria fleckii*, *Pogonaffhria squarrosa*, *Populus* spp., *Prosopis cineraria*, *Pseudotsuga menziesii*, *Pterolobium stellatum*, *Pyrus communis*, *Quercus* spp., *Rhaphiolepsis umbellata*, *Rhopalostylis sapida*, *Rhus natalensis*, *Ribes grossularia*, *Ribes* spp., *Robinia pseudoacacia*, *Rosa* spp., *Rubus* spp., *Salix* spp., *Schyzachyrium sanguineum*, *Sciadopitys vefficillata*, *Sequoia sempervirens*, *Sequoiadendron giganteum*, *Sorghum bicolor*, *Spinacia* spp., *Sporobolus fimbriatus*, *Stiburus alopecuroides*, *Stylosanthos humilis*, *Tadehagi* spp, *Taxodium distichum*, *Themeda triandra*, *Trifolium* spp., *Triticum* spp., *Tsuga heterophylla*, *Vaccinium* spp., *Vicia* spp., *Vitis vinifera*, *Watsonia pyramidata*, *Zantedeschia aethiopica*, *Zea mays*, amaranth, artichoke, asparagus, broccoli, Brussels sprouts, cabbage, canola, carrot, cauliflower, celery, collard greens, flax, kale, lentil, oilseed rape, okra, onion, potato, rice, soybean, straw, sugar beet, sugar cane, sunflower, tomato, squash tea, maize, wheat, barely, rye, oat, peanut, pea, lentil and alfalfa, cotton, rapeseed, canola, pepper, sunflower, tobacco, eggplant, eucalyptus, a tree, an ornamental plant, a perennial grass and a forage crop. Alternatively algae and other non-Viridiplantae can be used for the methods of the present invention.

According to some embodiments of the invention, the plant used by the method of the invention is a crop plant such as rice, maize, wheat, barley, peanut, potato, sesame, olive tree, palm oil, banana, soybean, sunflower, canola, sugarcane, alfalfa, millet, leguminosae (bean, pea), flax, lupinus, rapeseed, tobacco, popular and cotton.

Expressing the exogenous polynucleotide of the invention within the plant can be effected by transforming one or more cells of the plant with the exogenous polynucleotide, followed by generating a mature plant from the transformed cells and cultivating the mature plant under conditions suitable for expressing the exogenous polynucleotide within the mature plant.

According to some embodiments of the invention, the transformation is effected by introducing to the plant cell a nucleic acid construct which includes the exogenous polynucleotide of some embodiments of the invention and at least one promoter capable of directing transcription of the exogenous polynucleotide in the plant cell. Further details of suitable transformation approaches are provided hereinbelow.

As used herein, the term "promoter" refers to a region of DNA which lies upstream of the transcriptional initiation site of a gene to which RNA polymerase binds to initiate transcription of RNA. The promoter controls where (e.g., which portion of a plant) and/or when (e.g., at which stage or condition in the lifetime of an organism) the gene is expressed.

Any suitable promoter sequence can be used by the nucleic acid construct of the present invention. According to some embodiments of the invention, the promoter is a constitutive promoter, a tissue-specific, or an abiotic stress-inducible promoter.

Suitable constitutive promoters include, for example, CaMV 35S promoter (SEQ ID NO:1546; Odell et al., Nature 313:810-812, 1985); *Arabidopsis* At6669 promoter (SEQ ID NO:1652; see PCT Publication No. WO04081173A2); maize Ubi 1 (Christensen et al., Plant Sol. Biol. 18:675-689, 1992); rice actin (McElroy et al., Plant Cell 2:163-171, 1990); pEMU (Last et al., Theor. Appl. Genet. 81:581-588, 1991); CaMV 19S (Nilsson et al., Physiol. Plant 100:456-462, 1997); GOS2 (de Pater et al., Plant J November; 2(6):837-44, 1992); ubiquitin (Christensen et al., Plant Mol. Biol. 18: 675-689, 1992); Rice cyclophilin (Bucholz et al., Plant Mol Biol. 25(5):837-43, 1994); Maize H3 histone (Lepetit et al., Mol. Gen. Genet. 231: 276-285, 1992); Actin 2 (An et al., Plant J. 10(1); 107-121, 1996), constitutive root tip CT2 promoter (SEQ ID NO:1535; see also PCT application No. IL/2005/000627) and Synthetic Super MAS (Ni et al., The Plant Journal 7: 661-76, 1995). Other constitutive promoters include those in U.S. Pat. Nos. 5,659,026, 5,608,149; 5,608, 144; 5,604,121; 5,569,597; 5,466,785; 5,399,680; 5,268,463; and 5,608,142.

Suitable tissue-specific promoters include, but not limited to, leaf-specific promoters [such as described, for example, by Yamamoto et al., Plant J. 12:255-265, 1997; Kwon et al., Plant Physiol. 105:357-67, 1994; Yamamoto et al., Plant Cell Physiol. 35:773-778, 1994; Gotor et al., Plant J. 3:509-18, 1993; Orozco et al., Plant Mol. Biol. 23:1129-1138, 1993; and Matsuoka et al., Proc. Natl. Acad. Sci. USA 90:9586-9590, 1993], seed-preferred promoters [e.g., from seed specific genes (Simon, et al., Plant Mol. Biol. 5. 191, 1985; Scofield, et al., J. Biol. Chem. 262: 12202, 1987; Baszczynski, et al., Plant Mol. Biol. 14: 633, 1990), Brazil Nut albumin (Pearson' et al., Plant Mol. Biol. 18: 235-245, 1992), legumin (Ellis, et al. Plant Mol. Biol. 10: 203-214, 1988), Glutelin (rice) (Takaiwa, et al., Mol. Gen. Genet. 208: 15-22, 1986; Takaiwa, et al., FEBS Letts. 221: 43-47, 1987), Zein (Matzke et al., Plant Mol Biol, 143). 323-32 1990), napA (Stalberg, et al., Planta 199: 515-519, 1996), Wheat SPA (Albanietal, Plant Cell, 9: 171-184, 1997), sunflower oleosin (Cummins, et al., Plant Mol. Biol. 19: 873-876, 1992)], endosperm specific promoters [e.g., wheat LMW and HMW, glutenin-1 (Mol Gen Genet 216:81-90, 1989; NAR 17:461-2), wheat a, b and g gliadins (EMBO3:1409-15, 1984), Barley ltrl promoter, barley B1, C, D hordein (Theor Appl Gen 98:1253-62, 1999; Plant J 4:343-55, 1993; Mol Gen Genet 250:750-60, 1996), Barley DOF (Mena et al., The Plant Journal, 116(1): 53-62, 1998), Biz2 (EP99106056.7), Synthetic promoter (Vicente-Carbajosa et al., Plant J. 13: 629-640, 1998), rice prolamin NRP33, rice-globulin Glb-1 (Wu et al., Plant Cell Physiology 39(8) 885-889, 1998), rice alpha-globulin REB/OHP-1 (Nakase et al. Plant Mol. Biol. 33: 513-S22, 1997), rice ADP-glucose PP (Trans Res 6:157-68, 1997), maize ESR gene family (Plant J 12:235-46, 1997), sorgum gamma-kafirin (PMB 32:1029-35, 1996)], embryo specific promoters [e.g., rice OSH1 (Sato et al., Proc. Nati. Acad. Sci. USA, 93: 8117-8122), KNOX (Postma-Haarsma of al, Plant Mol. Biol. 39:257-71, 1999), rice oleosin (Wu et at, J. Biochem., 123: 386, 1998)], and flower-specific promoters [e.g., AtPRP4, chalene synthase (chsA) (Van der Meer, et al., Plant Mol. Biol. 15, 95-109, 1990), LAT52 (Twell et al., Mol. Gen Genet. 217:240-245; 1989), apetala-3].

Suitable abiotic stress-inducible promoters include, but not limited to, salt-inducible promoters such as RD29A (Yamaguchi-Shinozalei et al., Mol. Gen. Genet. 236:331-340, 1993); drought-inducible promoters such as maize rab17 gene promoter (Pla et. al., Plant Mol. Biol. 21:259-266, 1993), maize rab28 gene promoter (Busk et. al., Plant J. 11:1285-1295, 1997) and maize Ivr2 gene promoter (Pelleschi et. al., Plant Mol. Biol. 39:373-380, 1999); heat-inducible promoters such as heat tomato hsp80-promoter from tomato (U.S. Pat. No. 5,187,267).

The nucleic acid construct of some embodiments of the invention can further include an appropriate selectable marker and/or an origin of replication. According to some embodiments of the invention, the nucleic acid construct utilized is a shuttle vector, which can propagate both in *E. coli* (wherein the construct comprises an appropriate selectable marker and origin of replication) and be compatible with propagation in cells. The construct according to the present invention can be, for example, a plasmid, a bacmid, a phagemid, a cosmid, a phage, a virus or an artificial chromosome.

The nucleic acid construct of some embodiments of the invention can be utilized to stably or transiently transform plant cells. In stable transformation, the exogenous polynucleotide is integrated into the plant genome and as such it represents a stable and inherited trait. In transient transformation, the exogenous polynucleotide is expressed by the cell transformed but it is not integrated into the genome and as such it represents a transient trait.

There are various methods of introducing foreign genes into both monocotyledonous and dicotyledonous plants (Potrykus, I., Annu Rev. Plant. Physiol., Plant. Mol. Biol. (1991) 42:205-225; Shimamoto et al., Nature (1989) 338:274-276).

The principle methods of causing stable integration of exogenous DNA into plant genomic DNA include two main approaches:

(i) *Agrobacterium*-mediated gene transfer: Klee et al. (1987) Annu Rev. Plant Physiol. 38:467-486; Klee and Rogers in Cell Culture and Somatic Cell Genetics of Plants, Vol. 6, Molecular Biology of Plant Nuclear Genes, eds. Schell, J., and Vasil, L. K., Academic Publishers, San Diego, Calif. (1989) p. 2-25; Gatenby, in Plant Biotechnology, eds. Kung, S. and Arntzen, C. J., Butterworth Publishers, Boston, Mass. (1989) p. 93-112.

(ii) Direct DNA uptake: Paszkowski et al., in Cell Culture and Somatic Cell Genetics of Plants, Vol. 6, Molecular Biology of Plant Nuclear Genes eds. Schell, J., and Vasil, L. K., Academic Publishers, San Diego, Calif. (1989) p. 52-68; including methods for direct uptake of DNA into protoplasts, Toriyama, K. et al. (1988) Bio/Technology 6:1072-1074. DNA uptake induced by brief electric shock of plant cells: Zhang et al. Plant Cell Rep. (1988) 7:379-384. Fromm et al. Nature (1986) 319:791-793. DNA injection into plant cells or tissues by particle bombardment, Klein et al. Bio/Technology (1988) 6:559-563; McCabe et al. Bio/Technology (1988) 6:923-926; Sanford, Physiol. Plant. (1990) 79:206-209; by the use of micropipette systems: Neuhaus et al., Theor. Appl. Genet. (1987) 75:30-36; Neuhaus and Spangenberg, Physiol. Plant. (1990) 79:213-217; glass fibers or silicon carbide whisker transformation of cell cultures, embryos or callus tissue, U.S. Pat. No. 5,464,765 or by the direct incubation of DNA with germinating pollen, DeWet et al. in Experimental Manipulation of Ovule Tissue, eds. Chapman, G. P. and Mantell, S. H. and Daniels, W. Longman, London, (1985) p. 197-209; and Ohta, Proc. Natl. Acad. Sci. USA (1986) 83:715-719.

The *Agrobacterium* system includes the use of plasmid vectors that contain defined DNA segments that integrate into the plant genomic DNA. Methods of inoculation of the plant tissue vary depending upon the plant species and the *Agrobacterium* delivery system. A widely used approach is the leaf disc procedure which can be performed with any tissue explant that provides a good source for initiation of whole plant differentiation. See, e.g., Horsch et al. in Plant Molecular Biology Manual A5, Kluwer Academic Publishers, Dordrecht (1988) p. 1-9. A supplementary approach employs the *Agrobacterium* delivery system in combination with vacuum infiltration. The *Agrobacterium* system is especially viable in the creation of transgenic dicotyledonous plants.

There are various methods of direct DNA transfer into plant cells. In electroporation, the protoplasts are briefly exposed to a strong electric field. In microinjection, the DNA is mechanically injected directly into the cells using very small micropipettes. In microparticle bombardment, the DNA is adsorbed on microprojectiles such as magnesium sulfate crystals or tungsten particles, and the microprojectiles are physically accelerated into cells or plant tissues.

Following stable transformation plant propagation is exercised. The most common method of plant propagation is by seed. Regeneration by seed propagation, however, has the deficiency that due to heterozygosity there is a lack of uniformity in the crop, since seeds are produced by plants according to the genetic variances governed by Mendelian rules. Basically, each seed is genetically different and each will grow with its own specific traits. Therefore, it is preferred that the transformed plant be produced such that the regenerated plant has the identical traits and characteristics of the parent transgenic plant. For this reason it is preferred that the transformed plant be regenerated by micropropagation which provides a rapid, consistent reproduction of the transformed plants.

Micropropagation is a process of growing new generation plants from a single piece of tissue that has been excised from a selected parent plant or cultivar. This process permits the mass reproduction of plants having the preferred tissue expressing the fusion protein. The new generation plants which are produced are genetically identical to, and have all of the characteristics of, the original plant. Micropropagation allows mass production of quality plant material in a short period of time and offers a rapid multiplication of selected cultivars in the preservation of the characteristics of the original transgenic or transformed plant. The advantages of cloning plants are the speed of plant multiplication and the quality and uniformity of plants produced.

Micropropagation is a multi-stage procedure that requires alteration of culture medium or growth conditions between stages. Thus, the micropropagation process involves four basic stages: Stage one, initial tissue culturing; stage two, tissue culture multiplication; stage three, differentiation and plant formation; and stage four, greenhouse culturing and hardening. During stage one, initial tissue culturing, the tissue culture is established and certified contaminant-free. During stage two, the initial tissue culture is multiplied until a sufficient number of tissue samples are produced to meet production goals. During stage three, the tissue samples grown in stage two are divided and grown into individual plantlets. At stage four, the transformed plantlets are transferred to a greenhouse for hardening where the plants' tolerance to light is gradually increased so that it can be grown in the natural environment.

According to some embodiments of the invention, the transgenic plants are generated by transient transformation of leaf cells, meristematic cells or the whole plant.

Transient transformation can be effected by any of the direct DNA transfer methods described above or by viral infection using modified plant viruses.

Viruses that have been shown to be useful for the transformation of plant hosts include CaMV, Tobacco mosaic virus (TMV), brome mosaic virus (BMV) and Bean Common Mosaic Virus (BV or BCMV). Transformation of plants using plant viruses is described in U.S. Pat. No. 4,855,237 (bean golden mosaic virus; BGV), EP-A 67,553 (TMV), Japanese Published Application No. 63-14693 (TMV), EPA 194,809 (BV), EPA 278,667 (BV); and Gluzman, Y. et al., Communications in Molecular Biology: Viral Vectors, Cold Spring Harbor Laboratory, New York, pp. 172-189 (1988). Pseudovirus particles for use in expressing foreign DNA in many hosts, including plants are described in WO 87/06261.

According to some embodiments of the invention, the virus used for transient transformations is avirulent and thus is incapable of causing severe symptoms such as reduced growth rate, mosaic, ring spots, leaf roll, yellowing, streaking, pox formation, tumor formation and pitting. A suitable avirulent virus may be a naturally occurring avirulent virus or an artificially attenuated virus. Virus attenuation may be effected by using methods well known in the art including, but not limited to, sub-lethal heating, chemical treatment or by directed mutagenesis techniques such as described, for example, by Kurihara and Watanabe (Molecular Plant Pathology 4:259-269, 2003), Gal-on et al. (1992), Atreya et al. (1992) and Huet et al. (1994).

Suitable virus strains can be obtained from available sources such as, for example, the American Type culture Collection (ATCC) or by isolation from infected plants. Isolation of viruses from infected plant tissues can be effected by techniques well known in the art such as described, for example by Foster and Tatlor, Eds. "Plant Virology Protocols: From Virus Isolation to Transgenic Resistance (Methods in Molecular Biology (Humana Pr), Vol 81)", Humana Press, 1998. Briefly, tissues of an infected plant believed to contain a high concentration of a suitable virus, preferably young leaves and flower petals, are ground in a buffer solution (e.g., phosphate buffer solution) to produce a virus infected sap which can be used in subsequent inoculations.

Construction of plant RNA viruses for the introduction and expression of non-viral exogenous polynucleotide sequences in plants is demonstrated by the above references as well as by Dawson, W. O. et al., Virology (1989) 172:285-292; Takamatsu et al. EMBO J. (1987) 6:307-311; French et al. Science (1986) 231:1294-1297; Takamatsu et al. FEBS Letters (1990) 269:73-76; and U.S. Pat. No. 5,316,931.

When the virus is a DNA virus, suitable modifications can be made to the virus itself. Alternatively, the virus can first be cloned into a bacterial plasmid for ease of constructing the desired viral vector with the foreign DNA. The virus can then be excised from the plasmid. If the virus is a DNA virus, a bacterial origin of replication can be attached to the viral DNA, which is then replicated by the bacteria. Transcription and translation of this DNA will produce the coat protein which will encapsidate the viral DNA. If the virus is an RNA virus, the virus is generally cloned as a cDNA and inserted into a plasmid. The plasmid is then used to make all of the constructions. The RNA virus is then produced by transcribing the viral sequence of the plasmid and translation of the viral genes to produce the coat protein(s) which encapsidate the viral RNA.

In one embodiment, a plant viral polynucleotide is provided in which the native coat protein coding sequence has been deleted from a viral polynucleotide, a non-native plant viral coat protein coding sequence and a non-native promoter, preferably the subgenomic promoter of the non-native coat protein coding sequence, capable of expression in the plant host, packaging of the recombinant plant viral polynucleotide, and ensuring a systemic infection of the host by the recombinant plant viral polynucleotide, has been inserted. Alternatively, the coat protein gene may be inactivated by insertion of the non-native polynucleotide sequence within it, such that a protein is produced. The recombinant plant viral polynucleotide may contain one or more additional non-native subgenomic promoters. Each non-native subgenomic promoter is capable of transcribing or expressing adjacent genes or polynucleotide sequences in the plant host and incapable of recombination with each other and with native subgenomic promoters. Non-native (foreign) polynucleotide sequences may be inserted adjacent the native plant viral subgenomic promoter or the native and a non-native plant viral subgenomic promoters if more than one polynucleotide sequence is included. The non-native polynucleotide sequences are transcribed or expressed in the host plant under control of the subgenomic promoter to produce the desired products.

In a second embodiment, a recombinant plant viral polynucleotide is provided as in the first embodiment except that the native coat protein coding sequence is placed adjacent one of the non-native coat protein subgenomic promoters instead of a non-native coat protein coding sequence.

In a third embodiment, a recombinant plant viral polynucleotide is provided in which the native coat protein gene is adjacent its subgenomic promoter and one or more non-native subgenomic promoters have been inserted into the viral polynucleotide. The inserted non-native subgenomic promoters are capable of transcribing or expressing adjacent genes in a plant host and are incapable of recombination with each other and with native subgenomic promoters. Non-native polynucleotide sequences may be inserted adjacent the non-native subgenomic plant viral promoters such that the sequences are transcribed or expressed in the host plant under control of the subgenomic promoters to produce the desired product.

In a fourth embodiment, a recombinant plant viral polynucleotide is provided as in the third embodiment except that the native coat protein coding sequence is replaced by a non-native coat protein coding sequence.

The viral vectors are encapsidated by the coat proteins encoded by the recombinant plant viral polynucleotide to produce a recombinant plant virus. The recombinant plant viral polynucleotide or recombinant plant virus is used to infect appropriate host plants. The recombinant plant viral polynucleotide is capable of replication in the host, systemic spread in the host, and transcription or expression of foreign gene(s) (exogenous polynucleotide) in the host to produce the desired protein.

Techniques for inoculation of viruses to plants may be found in Foster and Taylor, eds. "Plant Virology Protocols: From Virus Isolation to Transgenic Resistance (Methods in Molecular Biology (Humana Pr), Vol 81)", Humana Press, 1998; Maramorosh and Koprowski, eds. "Methods in Virology" 7 vols, Academic Press, New York 1967-1984; Hill, S. A. "Methods in Plant Virology", Blackwell, Oxford, 1984; Walkey, D. G. A. "Applied Plant Virology", Wiley, New York, 1985; and Kado and Agrawa, eds. "Principles and Techniques in Plant Virology", Van Nostrand-Reinhold, New York.

In addition to the above, the polynucleotide of the present invention can also be introduced into a chloroplast genome thereby enabling chloroplast expression.

A technique for introducing exogenous polynucleotide sequences to the genome of the chloroplasts is known. This technique involves the following procedures. First, plant cells are chemically treated so as to reduce the number of chloroplasts per cell to about one. Then, the exogenous polynucleotide is introduced via particle bombardment into the cells with the aim of introducing at least one exogenous polynucleotide molecule into the chloroplasts. The exogenous polynucleotide is selected such that it is integratable into the chloroplast's genome via homologous recombination which is readily effected by enzymes inherent to the chloroplast. To this end, the exogenous polynucleotide includes, in addition to a gene of interest, at least one polynucleotide stretch which is derived from the chloroplast's genome. In addition, the exogenous polynucleotide includes a selectable marker, which serves by sequential selection procedures to ascertain that all or substantially all of the copies of the chloroplast genomes following such selection will include the exogenous polynucleotide. Further details relating to this technique are found in U.S. Pat. Nos. 4,945,050; and 5,693,507 which are incorporated herein by reference. A polypeptide can thus be produced by the protein expression system of the chloroplast and become integrated into the chloroplast's inner membrane.

Since abiotic stress tolerance, growth, biomass, yield and/or vigor in plants can involve multiple genes acting additively or in synergy (see, for example, in Quesda et al., Plant Physiol. 130:951-063, 2002), the present invention also envisages expressing a plurality of exogenous polynucleotides in a single host plant to thereby achieve superior effect on abiotic stress tolerance, growth, biomass, yield and/or vigor.

Expressing a plurality of exogenous polynucleotides in a single host plant can be effected by co-introducing multiple nucleic acid constructs, each including a different exogenous polynucleotide, into a single plant cell. The transformed cell can then be regenerated into a mature plant using the methods described hereinabove.

Alternatively, expressing a plurality of exogenous polynucleotides in a single host plant can be effected by co-introducing into a single plant-cell a single nucleic-acid construct including a plurality of different exogenous polynucleotides. Such a construct can be designed with a single promoter sequence which can transcribe a polycistronic messenger RNA including all the different exogenous polynucleotide sequences. To enable co-translation of the different polypeptides encoded by the polycistronic messenger RNA, the polynucleotide sequences can be inter-linked via an internal ribosome entry site (IRES) sequence which facilitates translation of polynucleotide sequences positioned downstream of the IRES sequence. In this case, a transcribed polycistronic RNA molecule encoding the different polypeptides described above will be translated from both the capped 5' end and the two internal IRES sequences of the polycistronic RNA molecule to thereby produce in the cell all different polypeptides. Alternatively, the construct can include several promoter sequences each linked to a different exogenous polynucleotide sequence.

The plant cell transformed with the construct including a plurality of different exogenous polynucleotides can be regenerated into a mature plant, using the methods described hereinabove.

Alternatively, expressing a plurality of exogenous polynucleotides can be effected by introducing different nucleic acid constructs, including different exogenous polynucleotides, into a plurality of plants. The regenerated transformed plants can then be cross-bred and resultant progeny selected for superior abiotic stress tolerance, growth, biomass, yield and/or vigor traits, using conventional plant breeding techniques.

According to some embodiments of the invention, the plant expressing the exogenous polynucleotide(s) is grown under normal conditions.

According to some embodiments of the invention, the method further comprising growing the plant expressing the exogenous polynucleotide(s) under the abiotic stress.

Thus, the invention encompasses plants exogenously expressing (as described above) the polynucleotide(s) and/or polypeptide(s) of the invention. Once expressed within the plant cell or the entire plant, the level of the polypeptide encoded by the exogenous polynucleotide can be determined by methods well known in the art such as, activity assays, Western blots using antibodies capable of specifically binding the polypeptide, Enzyme-Linked ImmunoSorbent Assay (ELISA), radio-immuno-assays (RIA), immunohistochemistry, immunocytochemistry, immunofluorescence and the like.

Methods of determining the level in the plant of the RNA transcribed from the exogenous polynucleotide are well known in the art and include, for example, Northern blot analysis, reverse transcription polymerase chain reaction (RT-PCR) analysis (including quantitative, semi-quantitative or real-time RT-PCR) and RNA-in situ hybridization.

The polynucleotides and polypeptides described hereinabove can be used in a wide range of economical plants, in a safe and cost effective manner.

The effect of the transgene (the exogenous polynucleotide encoding the polypeptide) on abiotic stress tolerance, growth, biomass, yield and/or vigor can be determined using known methods.

Abiotic Stress Tolerance—

Transformed (i.e., expressing the transgene) and non-transformed (wild type) plants are exposed to an abiotic stress condition, such as water deprivation, suboptimal temperature (low temperature, high temperature), nutrient deficiency, nutrient excess, a salt stress condition, osmotic stress, heavy metal toxicity, anaerobiosis, atmospheric pollution and UV irradiation.

Salinity Tolerance Assay—

Transgenic plants with tolerance to high salt concentrations are expected to exhibit better germination, seedling vigor or growth in high salt. Salt stress can be effected in many ways such as, for example, by irrigating the plants with a hyperosmotic solution, by cultivating the plants hydroponically in a hyperosmotic growth solution (e.g., Hoagland solution with added salt), or by culturing the plants in a hyperosmotic growth medium [e.g., 50% Murashige-Skoog medium (MS medium) with added salt]. Since different plants vary considerably in their tolerance to salinity, the salt concentration in the irrigation water, growth solution, or growth medium can be adjusted according to the specific characteristics of the specific plant cultivar or variety, so as to inflict a mild or moderate effect on the physiology and/or morphology of the plants (for guidelines as to appropriate concentration see, Bernstein and Kafkafi, Root Growth Under Salinity Stress In: Plant Roots, The Hidden Half 3rd ed. Waisel Y, Eshel A and Kafkafi U. (editors) Marcel Dekker Inc., New York, 2002, and reference therein).

For example, a salinity tolerance test can be performed by irrigating plants at different developmental stages with increasing concentrations of sodium chloride (for example 50 mM, 100 mM, 200 mM, 400 mM NaCl) applied from the bottom and from above to ensure even dispersal of salt. Following exposure to the stress condition the plants are frequently monitored until substantial physiological and/or morphological effects appear in wild type plants. Thus, the external phenotypic appearance, degree of wilting and overall success to reach maturity and yield progeny are compared between control and transgenic plants. Quantitative parameters of tolerance measured include, but are not limited to, the average wet and dry weight, growth rate, leaf size, leaf coverage (overall leaf area), the weight of the seeds yielded, the average seed size and the number of seeds produced per plant. Transformed plants not exhibiting substantial physiological and/or morphological effects, or exhibiting higher biomass than wild-type plants, are identified as abiotic stress tolerant plants.

Osmotic Tolerance Test—

Osmotic stress assays (including sodium chloride and PEG assays) are conducted to determine if an osmotic stress phenotype was sodium chloride-specific or if it was a general osmotic stress related phenotype. Plants which are tolerant to osmotic stress may have more tolerance to drought and/or freezing. For salt and osmotic stress experiments, the medium is supplemented for example with 50 mM, 100 mM, 200 mM NaCl or 15%, 20% or 25% PEG. See also Examples 6 and 7 of the Examples section which follows.

Drought Tolerance Assay/Osmoticum Assay—

Tolerance to drought is performed to identify the genes conferring better plant survival after acute water deprivation. To analyze whether the transgenic plants are more tolerant to drought, an osmotic stress produced by the non-ionic osmolyte sorbitol in the medium can be performed. Control and transgenic plants are germinated and grown in plant-agar plates for 4 days, after which they are transferred to plates containing 500 mM sorbitol. The treatment causes growth retardation, then both control and transgenic plants are compared, by measuring plant weight (wet and dry), yield, and by growth rates measured as time to flowering.

Conversely, soil-based drought screens are performed with plants overexpressing the polynucleotides detailed above. Seeds from control *Arabidopsis* plants, or other transgenic plants overexpressing the polypeptide of the invention are germinated and transferred to pots. Drought stress is obtained after irrigation is ceased accompanied by placing the pots on absorbent paper to enhance the soil-drying rate. Transgenic and control plants are compared to each other when the majority of the control plants develop severe wilting. Plants are re-watered after obtaining a significant fraction of the control plants displaying a severe wilting. Plants are ranked comparing to controls for each of two criteria: tolerance to the drought conditions and recovery (survival) following re-watering.

Cold Stress Tolerance—

One way to analyze cold stress is as follows. Mature (25 day old) plants are transferred to 4° C. chambers for 1 or 2 weeks, with constitutive light. Later on plants are moved back to greenhouse. Two weeks later damages from chilling period, resulting in growth retardation and other phenotypes, are compared between control and transgenic plants, by measuring plant weight (wet and dry), and by comparing growth rates measured as time to flowering, plant size, yield, and the like.

Heat Stress Tolerance—

One way to measure heat stress tolerance is by exposing the plants to temperatures above 34° C. for a certain period. Plant tolerance is examined after transferring the plants back to 22°

C. for recovery and evaluation after 5 days relative to internal controls (non-transgenic plants) or plants not exposed to neither cold or heat stress.

Germination Tests—

Germination tests compare the percentage of seeds from transgenic plants that could complete the germination process to the percentage of seeds from control plants that are treated in the same manner. Normal conditions are considered for example, incubations at 22° C. under 22-hour light 2-hour dark daily cycles. Evaluation of germination and seedling vigor is conducted between 4 and 14 days after planting. The basal media is 50% MS medium (Murashige and Skoog, 1962 Plant Physiology 15, 473-497).

Germination is checked also at unfavorable conditions such as cold (incubating at temperatures lower than 10° C. instead of 22° C.) or using seed inhibition solutions that contain high concentrations of an osmolyte such as sorbitol (at concentrations of 50 mM, 100 mM, 200 mM, 300 mM, 500 mM, and up to 1000 mM) or applying increasing concentrations of salt (of 50 mM, 100 mM, 200 mM, 300 mM, 500 mM NaCl).

Effect of the Transgene on Plant's Growth, Biomass, Yield and/or Vigor—

Plant vigor can be calculated by the increase in growth parameters such as leaf area, fiber length, rosette diameter, plant fresh weight and the like per time.

The growth rate can be measured using digital analysis of growing plants. For example, images of plants growing in greenhouse on plot basis can be captured every 3 days and the rosette area can be calculated by digital analysis. Rosette area growth is calculated using the difference of rosette area between days of sampling divided by the difference in days between samples.

Measurements of seed yield can be done by collecting the total seeds from 8-16 plants together, weighting them using analytical balance and dividing the total weight by the number of plants. Seed per growing area can be calculated in the same manner while taking into account the growing area given to a single plant. Increase seed yield per growing area could be achieved by increasing seed yield per plant, and/or by increasing number of plants capable of growing in a given area.

Evaluation of the seed yield per plant can be done by measuring the amount (weight or size) or quantity (i.e., number) of dry seeds produced and harvested from 8-16 plants and divided by the number of plants.

Evaluation of growth rate can be done by measuring plant biomass produced, rosette area, leaf size or root length per time (can be measured in $cm^2$ per day of leaf area).

Fiber length can be measured using fibrograph. The fibrograph system was used to compute length in terms of "Upper Half Mean" length. The upper half mean (UHM) is the average length of longer half of the fiber distribution. The fibrograph measures length in span lengths at a given percentage point (Hypertext Transfer Protocol://World Wide Web (dot) cottoninc (dot) com/ClassificationofCotton/?Pg=4#Length).

Thus, the present invention is of high agricultural value for promoting the yield of commercially desired crops (e.g., biomass of vegetative organ such as poplar wood, or reproductive organ such as number of seeds or seed biomass).

As used herein the term "about" refers to ±10%.

The terms "comprises", "comprising", "includes", "including", "having" and their conjugates mean "including but not limited to".

The term "consisting of means "including and limited to".

The term "consisting essentially of" means that the composition, method or structure may include additional ingredients, steps and/or parts, but only if the additional ingredients, steps and/or parts do not materially alter the basic and novel characteristics of the claimed composition, method or structure.

As used herein, the singular form "a", "an" and "the" include plural references unless the context clearly dictates otherwise. For example, the term "a compound" or "at least one compound" may include a plurality of compounds, including mixtures thereof.

Throughout this application, various embodiments of this invention may be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

Whenever a numerical range is indicated herein, it is meant to include any cited numeral (fractional or integral) within the indicated range. The phrases "ranging/ranges between" a first indicate number and a second indicate number and "ranging/ranges from" a first indicate number "to" a second indicate number are used herein interchangeably and are meant to include the first and second indicated numbers and all the fractional and integral numerals therebetween.

As used herein the term "method" refers to manners, means, techniques and procedures for accomplishing a given task including, but not limited to, those manners, means, techniques and procedures either known to, or readily developed from known manners, means, techniques and procedures by practitioners of the chemical, pharmacological, biological, biochemical and medical arts.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable subcombination or as suitable in any other described embodiment of the invention. Certain features described in the context of various embodiments are not to be considered essential features of those embodiments, unless the embodiment is inoperative without those elements.

Various embodiments and aspects of the present invention as delineated hereinabove and as claimed in the claims section below find experimental support in the following examples.

EXAMPLES

Reference is now made to the following examples, which together with the above descriptions illustrate some embodiments of the invention in a non limiting fashion.

Generally, the nomenclature used herein and the laboratory procedures utilized in the present invention include molecular, biochemical, microbiological and recombinant DNA techniques. Such techniques are thoroughly explained in the literature. See, for example, "Molecular Cloning: A laboratory Manual" Sambrook et al., (1989); "Current Protocols in Molecular Biology" Volumes I-III Ausubel, R. M., ed. (1994); Ausubel et al., "Current Protocols in Molecular Biology", John Wiley and Sons, Baltimore, Md. (1989); Perbal, "A Practical Guide to Molecular Cloning", John Wiley & Sons, New York (1988); Watson et al., "Recombinant DNA", Scientific American Books, New York; Birren et al. (eds) "Genome Analysis: A Laboratory Manual Series", Vols. 1-4, Cold Spring Harbor Laboratory Press, New York (1998); methodologies as set forth in U.S. Pat. Nos. 4,666,828; 4,683,202; 4,801,531; 5,192,659 and 5,272,057; "Cell Biology: A Laboratory Handbook", Volumes I-III Cellis, J. E., ed. (1994); "Current Protocols in Immunology" Volumes I-III Coligan J. E., ed. (1994); Stites et al. (eds), "Basic and Clinical Immunology" (8th Edition), Appleton & Lange, Norwalk, Conn. (1994); Mishell and Shiigi (eds), "Selected Methods in Cellular Immunology", W.H. Freeman and Co., New York (1980); available immunoassays are extensively described in the patent and scientific literature, see, for example, U.S. Pat. Nos. 3,791,932; 3,839,153; 3,850,752; 3,850,578; 3,853,987; 3,867,517; 3,879,262; 3,901,654; 3,935,074; 3,984,533; 3,996,345; 4,034,074; 4,098,876; 4,879,219; 5,011,771 and 5,281,521; "Oligonucleotide Synthesis" Gait, M. J., ed. (1984); "Nucleic Acid Hybridization" Hames, B. D., and Higgins S. J., eds. (1985); "Transcription and Translation" Hames, B. D., and Higgins S. J., Eds. (1984); "Animal Cell Culture" Freshney, R. I., ed. (1986); "Immobilized Cells and Enzymes" IRL Press, (1986); "A Practical Guide to Molecular Cloning" Perbal, B., (1984) and "Methods in Enzymology" Vol. 1-317, Academic Press; "PCR Protocols: A Guide To Methods And Applications", Academic Press, San Diego, Calif. (1990); Marshak et al., "Strategies for Protein Purification and Characterization—A Laboratory Course Manual" CSHL Press (1996); all of which are incorporated by reference as if fully set forth herein. Other general references are provided throughout this document. The procedures therein are believed to be well known in the art and are provided for the convenience of the reader. All the information contained therein is incorporated herein by reference.

Example 1

Identifying Putative Abiotic Stress—Tolerance and or Yield/Biomass Increase Genes The present inventors have identified genes which increase abiotic stress-tolerance (ABST) and/or growth rate/yield/biomass/vigor, as follows. The genes were validated in vivo as previously described in WO2004/104162 to the present assignee. All nucleotide sequence datasets used here were originated from publicly available databases. Sequence data from 50 different species (mainly plant species) was introduced into a single, comprehensive database. Other information on gene expression, protein annotation, enzymes and pathways were also incorporated. Major databases used include:

Genomes

Arabidopsis genome [TAIR genome version 6 (Hypertext Transfer Protocol://World Wide Web (dot) arabidopsis (dot) org/)]

Rice genome [IRGSP build 4.0 (Hypertext Transfer Protocol://rgp (dot) dna (dot) affrc (dot) go (dot) jp/IRGSP/)].

Poplar [Populus trichocarpa release 1.1 from JGI (assembly release v1.0) (Hypertext Transfer Protocol://World Wide Web (dot) genome (dot) jgi-psf (dot) org/)]

Brachypodium [JGI 4x assembly Hypertext Transfer Protocol://World Wide Web (dot) brachpodium (dot) org)]

Soybean [DOE-JGI SCP, version Glyma0 (Hypertext Transfer Protocol://World Wide Web (dot) phytozome (dot) net/)]

Grape [NCBI WGS assembly ftp://ftp (dot) ncbi (dot) nih (dot) gov/genbank/wgs/)]

Castobean [TIGR/J Craig Venter Institute 4x assemby Hypertext Transfer Protocol://msc (dot) jcvi (dot) org/r_communis Sorghum [DOE-JGI SCP, version Sbil Hypertext Transfer Protocol://World Wide Web (dot) phytozome (dot) net/)].

Expressed EST and mRNA sequences were extracted from GeneBank versions 154, 157, 160, 161, 164, and 165 (Hypertext Transfer Protocol://World Wide Web (dot) ncbi (dot) nlm (dot) nih (dot) gov/dbEST/)

RefSeq (Hypertext Transfer Protocol://World Wide Web (dot) ncbi (dot) nlm (dot) nih (dot) gov/RefSeq/).

TAIR (Hypertext Transfer Protocol://World Wide Web (dot) arabidopsis (dot) org/).

Protein and pathway databases

Uniprot (Hypertext Transfer Protocol://World Wide Web.expasy.uniprot.org/).

AraCyc (Hypertext Transfer Protocol://World Wide Web (dot) arabidopsis (dot) org/biocyc/index (dot) jsp).

ENZYME (Hypertext Transfer Protocol://expasy.org/enzyme/).

Microarray datasets were downloaded from

GEO (Hypertext Transfer Protocol://World Wide Web.ncbi.nlm.nih.gov/geo/)

TAIR (Hypertext Transfer Protocol://World Wide Web.arabidopsis.org/).

Proprietary Evogene's cotton fiber microarray data

QTL information

Gramene (Hypertext Transfer Protocol://World Wide Web (dot) gramene (dot) org/qtl/).

Database Assembly was performed to build a wide, rich, reliable annotated and easy to analyze database comprised of publicly available genomic mRNA, ESTs DNA sequences, data from various crops as well as gene expression, protein annotation and pathway data QTLs, and other relevant information.

Database assembly is comprised of a toolbox of gene refining, structuring, annotation and analysis tools enabling to construct a tailored database for each gene discovery project. Gene refining and structuring tools enable to reliably detect splice variants and antisense transcripts, generating understanding of various potential phenotypic outcomes of a single gene. The capabilities of the "LEADS" platform of Compugen LTD for analyzing human genome have been confirmed and accepted by the scientific committee ("Widespread Antisense Transcription", Yelin, et al. (2003) Nature Biotechnology 21, 379-85; "Splicing of Alu Sequences", Lev-Maor, et al. (2003) Science 300 (5623), 1288-91), and have proven most efficient in plant genomics as well.

EST Clustering and Gene Assembly—

For clustering and assembly of arabidopsis and rice genes the "genomic LEADS" version was employed. This tool allows most accurate clustering of ESTs and mRNA sequences on genome, and predicts gene structure as well as alternative splicing events and anti-sense transcription.

For organisms with no available full genome sequence data, "expressed LEADS" as well as TIGR (Hypertext Transfer Protocol://World Wide Web (dot) tigr (dot) org/) clustering software were applied. The results of the two clustering tools were compared and in cases where clusters predicted by the two tools were significantly different, both versions were presented and considered.

Gene annotation—Predicted genes and proteins were annotated as follows:

Blast search (Hypertext Transfer Protocol://World Wide Web (dot) ncbi (dot) nlm (dot) nih (dot) gov (dot) library (dot) vu (dot) edu (dot) au/BLAST/) against all plant UniProt (Hypertext Transfer Protocol://World Wide Web (dot) expasy (dot) uniprot (dot) org/) sequences was performed.

Frame-Finder (Hypertext Transfer Protocol://World Wide Web (dot) ebi (dot) ac (dot) uk/~guy/estate/) calculations with default statistics was used to predict protein sequences for each transcript.

The predicted proteins were analyzed by InterPro (Hypertext Transfer Protocol://World Wide Web (dot) ebi (dot) ac (dot) uk/interpro/).

Blast against proteins from AraCyc and ENZYME databases was used to map the predicted transcripts to AraCyc pathways.

Each transcript was compared using tblastx algorithm (Hypertext Transfer Protocol://World Wide Web (dot) ncbi (dot) nlm (dot) nih (dot) gov (dot) library (dot) vu (dot) edu (dot) au/BLAST/) against all other organism databases to validate the accuracy of the predicted protein sequence, and for efficient detection of orthologs.

Gene Expression Profiling—

Few data sources were exploited for gene expression profiling, namely microarray data and digital expression profile (see below). According to gene expression profile, a correlation analysis was performed to identify genes which are co-regulated under different development stages and environmental conditions.

Publicly available microarray datasets were downloaded from TAIR and NCBI GEO sites, renormalized, and integrated into the database. Expression profiling was one of the most important resource data for identifying genes important for ABST. Moreover, when homolog genes from different crops were responsive to ABST, the genes were marked as "highly predictive to improve ABST".

A digital expression profile summary was compiled for each cluster according to all keywords included in the sequence records comprising the cluster. Digital expression, also known as electronic Northern Blot, is a tool that displays virtual expression profile based on the EST sequences forming the gene cluster. The tool can provide the expression profile of a cluster in terms of plant anatomy (in what tissues/organs is the gene expressed), developmental stage (the developmental stages at which a gene can be found) and profile of treatment (provides the physiological conditions under which a gene is expressed such as drought, cold, pathogen infection, etc). Given a random distribution of ESTs in the different clusters, the digital expression provides a probability value that describes the probability of a cluster having a total of N ESTs to contain X ESTs from a certain collection of libraries. For the probability calculations are taken into consideration: a) the number of ESTs in the cluster, b) the number of ESTs of the implicated and related libraries, c) the overall number of ESTs available representing the species. Thereby clusters with low probability values are highly enriched with ESTs from the group of libraries of interest indicating a specialized expression.

The concepts of orthology and paralogy have recently been applied to functional characterizations and classifications on the scale of whole-genome comparisons. Orthologs and paralogs constitute two major types of homologs: The first evolved from a common ancestor by specialization, and the latter are related by duplication events. It is assumed that paralogs arising from ancient duplication events are likely to have diverged in function while true orthologs are more likely to retain identical function over evolutionary time.

To further investigate and identify the ABST putative ortholog genes from monocot species, two computational methods were integrated:

(i) Method for Alignments of Ortholog Sequences—

Based on construction ortholog groups across multiple eukaryotic taxa, using modifications on the Markov cluster algorithm to group putative orthologs and paralogs. These putative orthologs were further organized under Phylogram—a branching diagram (tree) assumed to be an estimate of a phylogeny of the genes.

(ii) Method for Generating Genes Expression Profile "Digital Expression"—

The present inventors have performed considerable work aimed at annotating sequences. Expression data was analyzed and the EST libraries were classified using a fixed vocabulary of custom terms such as experimental treatments. The annotations from all the ESTs clustered to a gene were analyzed statistically by comparing their frequency in the cluster versus their abundance in the database, allowing to construct a numeric and graphic expression profile of that gene, which is termed "digital expression".

The rationale of using these two complementary methods is based on the assumption that true orthologs are likely to retain identical function over evolutionary time. These two methods (sequence and expression pattern) provide two different sets of indications on function similarities between two homologous genes, similarities in the sequence level—identical amino acids in the protein domains and similarity in expression profiles.

Overall, 110 genes were identified to have a major impact on ABST when overexpressed in plants. The identified ABST genes, their curated polynucleotide and polypeptide sequences, as well as their updated sequences according to Genebank database are summarized in Table 1, hereinbelow.

TABLE 1

| Identified ABST Genes | | | | | | |
|---|---|---|---|---|---|---|
| SEQ ID NO: Polynucleotide | Gene Name | Cluster Name | Organism | SEQ ID NO: Polypeptide | Polynucleotide Description | Polypeptide Description |
| 1 | MAB1 | MAB1.0.rice\|gb154\|BM421111_T1 | rice | 201 | | |
| 2 | | MAB1.1.rice\|gb157.2\|BM421111_T1 | rice | 202 | updated to production gb157.2 | updated to production gb157.2 |
| 3 | MAB2 | MAB2.0.rice\|gb154\|AU225547_T1 | rice | | | No predicted protein |

TABLE 1-continued

Identified ABST Genes

| SEQ ID NO: Polynucleotide | Gene Name | Cluster Name | Organism | SEQ ID NO: Polypeptide | Polynucleotide Description | Polypeptide Description |
|---|---|---|---|---|---|---|
| 4 | | MAB2.1.rice\|gb157.2\|AU225547_T1 | rice | | updated to production gb157.2 | |
| 5 | MAB3 | MAB3.0.rice\|gb154\|BE039995_T1 | rice | 203 | | |
| 6 | | MAB3.1.rice\|gb157.2\|BE039995_T1 | rice | 204 | updated to production gb157.2 | updated to production gb157.2 |
| 7 | MAB4 | MAB4.0.rice\|gb154\|BI812277_T1 | rice | 205 | | |
| 8 | | MAB4.7.rice\|gb157.2\|BI812277_CT1 | rice | | curated | |
| 9 | MAB5 | MAB5.0.rice\|gb154\|CB624106_T1 | rice | 206 | | |
| 10 | MAB6 | MAB6.0.arabidopsis\|gb154\|Z47404_T1 | arabidopsis | 207 | | |
| 11 | MAB7 | MAB7.0.arabidopsis\|6\|AT5G47560.1 | arabidopsis | 208 | | |
| 12 | | MAB7.1.arabidopsis\|gb165\|AT5G47560_T1 | arabidopsis | 209 | updated to production gb165 | updated to production gb165 |
| 13 | MAB8 | MAB8.0.rice\|gb154\|BU672931_T1 | rice | 210 | | |
| 14 | | MAB8.7.rice\|gb154\|BU672931_T1 | rice | | Bioinformatics & DNA Curated | |
| 15 | MAB9 | MAB9.0.arabidopsis\|gb154\|BE844934_T1 | arabidopsis | 211 | | |
| 16 | MAB10 | MAB10.0.arabidopsis\|gb154\|Z27056_T1 | arabidopsis | 212 | | |
| 17 | MAB11 | MAB11.0.arabidopsis\|gb154\|Z34014_T1 | arabidopsis | 213 | | |
| 18 | | MAB11.1.arabidopsis\|gb165\|AT5G52300_T1 | arabidopsis | 214 | updated to production gb165 | updated to production gb165 |
| 19 | MAB12 | MAB12.0.arabidopsis\|gb154\|ATLTIL40_T1 | arabidopsis | 215 | | |
| 20 | | MAB12.1.arabidopsis\|gb165\|AT5G52310_T1 | arabidopsis | 216 | updated to production gb165 | updated to production gb165 |
| 21 | MAB13 | MAB13.0.arabidopsis\|6\|AT2G38760.1 | arabidopsis | 217 | | |
| 22 | | MAB13.1.arabidopsis\|gb165\|AT2G38760_T1 | arabidopsis | 218 | updated to production gb165 | updated to production gb165 |
| 23 | MAB14 | MAB14.0.rice\|gb154\|AB042259_T1 | rice | 219 | | |
| 24 | | MAB14.1.rice\|gb157.2\|AB042259_T1 | rice | 220 | updated to production gb157.2 | updated to production gb157.2 |
| 25 | MAB15 | MAB15.0.sorghum\|gb154\|AI724695_T1 | sorghum | 221 | | |
| 26 | MAB16 | MAB16.0.rice\|gb154\|BI795172_T1 | rice | 222 | | |
| 27 | | MAB16.1.rice\|gb157.2\|BI795172_T1 | rice | 223 | updated to production gb157.2 | updated to production gb157.2 |
| 28 | MAB17 | MAB17.0.soybean\|gb154\|BE821839_T1 | soybean | 224 | | |
| 29 | MAB18 | MAB18.0.barley\|gb154\|BF625971_T1 | barley | 225 226 | | protein Bioinformatics & Protein Curated |
| 30 | MAB19 | MAB19.0.sorghum\|gb154\|AW563861_T1 | sorghum | 227 | | |
| 31 | | MAB19.1.sorghum\|gb161.xeno\|AW563861_T1 | sorghum | 228 | updated to production gb161.xeno | updated to production gb161.xeno |
| 32 | MAB20 | MAB20.0.arabidopsis\|gb154\|T04691_T1 | arabidopsis | 229 | | |
| 33 | | MAB20.1.arabidopsis\|gb165\|AT1G61890_T1 | arabidopsis | 230 | updated to production gb165 | updated to production gb165 |
| 34 | MAB21 | MAB21.0.rice\|gb154\|BE230053_T1 | rice | 231 | | |
| 35 | | MAB21.1.rice\|gb157.2\|BE230053_T1 | rice | 232 | updated to production gb157.2 | updated to production gb157.2 |
| 36 | MAB22 | MAB22.0.tomato\|gb154\|BG791299_T1 | tomato | 233 234 | | Curated |
| 37 | MAB23 | MAB23.0.rice\|gb154\|BI305810_T1 | rice | 235 | | |
| 38 | MAB24 | MAB24.0.rice\|gb154\|BI808273_T1 | rice | 236 | | |
| 39 | | MAB24.7.rice\|gb157.2\|BI808273_CT1 | rice | | curated | |
| 40 | MAB25 | MAB25.0.arabidopsis\|6\|AT1G27760.1 | arabidopsis | 237 | | |
| 41 | | MAB25.1.arabidopsis\|gb165\|AT1G27760_T1 | arabidopsis | 238 | updated to production gb165 | updated to production gb165 |

TABLE 1-continued

Identified ABST Genes

| SEQ ID NO: Polynucleotide | Gene Name | Cluster Name | Organism | SEQ ID NO: Polypeptide | Polynucleotide Description | Polypeptide Description |
|---|---|---|---|---|---|---|
| 42 | MAB26 | MAB26.0.rice\|gb154\|AW155625_T1 | rice | 239 | | |
| 43 | | MAB26.7.rice\|gb157.2\|BI305400_CT1 | rice | | curated | |
| 44 | MAB27 | MAB27.0.arabidopsis\|gb154\|AY045660_T1 | arabidopsis | 240 | | |
| 45 | | MAB27.7.arabidopsis\|gb165\|AT5G24120_CT1 | arabidopsis | | curated | |
| 46 | MAB28 | MAB28.0.rice\|gb154\|BI795108_T1 | rice | 241 | | |
| 47 | | MAB28.7.rice\|gb157.2\|BI795108_CT1 | rice | | curated | |
| 48 | MAB29 | MAB29.0.arabidopsis\|gb154\|AU239137_T2 | arabidopsis | 242 | | |
| 49 | | MAB29.1.arabidopsis\|gb165\|AT2G25600_T1 | arabidopsis | 243 | updated to production gb165 | updated to production gb165 |
| 50 | MAB30 | MAB30.0.arabidopsis\|gb154\|AY062542_T1 | arabidopsis | 244 | | |
| 51 | | MAB30.7.arabidopsis\|gb165\|AT1G70300_CT1 | arabidopsis | | Curated | |
| 52 | MAB31 | MAB31.0.soybean\|gb154\|BI968709_T1 | soybean | 245 | | |
| 53 | | MAB31.7.soybean\|gb162\|BI968709_CT1 | soybean | 246 | Curated | curated |
| 54 | MAB32 | MAB32.0.rice\|gb154\|AF039532_T1 | rice | 247 | | |
| 55 | MAB33 | MAB33.0.maize\|gb154\|AI615215_T1 | maize | 248 | | |
| 56 | | MAB33.1.maize\|gb164\|AI615215_T1 | maize | 249 | | updated to production gb164 |
| 57 | MAB34 | MAB34.0.barley\|gb154\|TG_BF625450_T1 | barley | 250 | | |
| 58 | | MAB34.1.barley\|gb157.2\|BF625450_T1 | barley | 251 | updated to production gb157.2 | updated to production gb157.2 |
| 59 | MAB35 | MAB35.0.arabidopsis\|gb154\|AA651513_T1 | arabidopsis | 252 | | |
| 60 | | MAB35.1.arabidopsis\|gb165\|AT2G16890_T1 | arabidopsis | 253 | updated to production gb165 | updated to production gb165 |
| 61 | MAB36 | MAB36.0.arabidopsis\|gb154\|AU239340_T1 | arabidopsis | 254 | | |
| 62 | | MAB36.1.arabidopsis\|gb165\|AT4G27570_T1 | arabidopsis | 255 | updated to production gb165 | updated to production gb165 |
| 63 | MAB37 | MAB37.0.tomato\|gb154\|BG125939_T1 | tomato | 256 | | |
| 64 | | MAB37.7.tomato\|gb164\|BG125939_CT1 | tomato | | curated | |
| 65 | MAB38 | MAB38.0.wheat\|gb154\|BE492836_T1 | wheat | 257 | | |
| 66 | | MAB38.7.wheat\|gb164\|BE492836_CT1 | wheat | 258 | curated | curated |
| 67 | MAB39 | MAB39.0.barley\|gb154\|AL500200_T1 | barley | 259 | | |
| 68 | | MAB39.1.barley\|gb157.2\|AL500200_T1 | barley | 260 | updated to production gb157.2 | updated to production gb157.2 |
| 69 | MAB40 | MAB40.0.rice\|gb154\|AA754628_T1 | rice | 261 | | |
| 70 | | MAB40.7.rice\|gb157.2\|AA754628_CT1 | rice | | curated | |
| 71 | MAB41 | MAB41.0.tomato\|gb154\|AI489494_T1 | tomato | 262 | | |
| 72 | | MAB41.7.tomato\|gb164\|AI489494_CT1 | tomato | | curated | |
| 73 | MAB42 | MAB42.0.sorghum\|gb154\|BE595950_T1 | sorghum | 263 | | |
| 74 | | MAB42.7.sorghum\|gb161.xeno\|AI881418_CT1 | sorghum | 264 | curated | curated |
| 75 | MAB43 | MAB43.0.arabidopsis\|gb154\|BE662945_T1 | arabidopsis | 265 | | |
| 76 | | MAB43.1.arabidopsis\|gb165\|AT5G26920_T1 | arabidopsis | 266 | updated to production gb165 | updated to production gb165 |
| 77 | MAB44 | MAB44.0.arabidopsis\|gb154\|H36025_T1 | arabidopsis | 267 | | |
| 78 | | MAB44.1.arabidopsis\|gb165\|AT1G67360_T1 | arabidopsis | 268 | updated to production gb165 | updated to production gb165 |
| 79 | MAB45 | MAB45.0.wheat\|gb154\|TG_BQ172359_T1 | wheat | 269 | | |
| 80 | | MAB45.1.wheat\|gb164\|BQ172359_T1 | wheat | 270 | updated to production gb164 | updated to production gb164 |
| 81 | MAB46 | MAB46.0.arabidopsis\|gb154\|AA389812_T1 | arabidopsis | 271 | | |
| 82 | MAB47 | MAB47.0.sorghum\|gb154\|AW672286_T1 | sorghum | 272 | | |
| 83 | | MAB47.7.sorghum\|gb161.xeno\|AI948276_CT1 | sorghum | 273 | Curated | Curated |
| 84 | MAB48 | MAB48.0.rice\|gb154\|BI802161_T1 | rice | 274 | | |

TABLE 1-continued

Identified ABST Genes

| SEQ ID NO: Polynucleotide | Gene Name | Cluster Name | Organism | SEQ ID NO: Polypeptide | Polynucleotide Description | Polypeptide Description |
|---|---|---|---|---|---|---|
| 85 | | MAB48.7.rice|gb157.2|AU092454_CT1 | rice | 275 | curated | curated |
| 86 | MAB49 | MAB49.0.maize|gb154|TG_AI621810_T1 | maize | 276 | | |
| 87 | | MAB49.7.maize|gb164|AI621810_CT1 | maize | | Curated | |
| 88 | MAB50 | MAB50.0.*arabidopsis*|gb154|W43146_T1 | *arabidopsis* | 277 | | |
| 89 | | MAB50.1.*arabidopsis*|gb165|AT5G48570_T1 | *arabidopsis* | 278 | updated to production gb165 | updated to production gb165 |
| 90 | MAB91 | MAB91.0.*arabidopsis*|gb154|AU236480_T1 | *arabidopsis* | 279 | | |
| | | | | 280 | | curated |
| 91 | MAB96 | MAB96.0.*arabidopsis*|gb154|Z27256_T1 | *arabidopsis* | 281 | | |
| 92 | | MAB96.7.*arabidopsis*|gb165|AT5G03800_CT1 | *arabidopsis* | 282 | curated | curated |
| 93 | MAB99 | MAB99.0.tomato|gb154|BG735056_T1 | tomato | 283 | | |
| 94 | MAB100 | MAB100.0.*arabidopsis*|gb154|Z37259_T1 | *arabidopsis* | 284 | | |
| 95 | | MAB100.1.*arabidopsis*|gb165|AT1G01470_T1 | *arabidopsis* | 285 | updated to production gb165 | updated to production gb165 |
| 96 | MAB104 | MAB104.0.rice|gb154|BE039215_T1 | rice | 286 | | |
| 97 | | MAB104.1.rice|gb157.2|BE039215_T1 | rice | 287 | updated to production gb157.2 | updated to production gb157.2 |
| 98 | MAB121 | MAB121.0.sugarcane|gb157|CA079500_T1 | sugarcane | 288 | | |
| 99 | | MAB121.1.sugarcane|gb157.2|CA079500_T1 | sugarcane | 289 | updated to production gb157.2 | updated to production gb157.2 |
| 100 | MAB122 | MAB122.0.maize|gb154|AI901344_T9 | maize | 290 | | |
| 101 | MAB123 | MAB123.0.barley|gb157|BF626638_T1 | barley | 291 | | |
| 102 | | MAB123.1.barley|gb157.2|BF626638_T1 | barley | 292 | updated to production gb157.2 | updated to production gb157.2 |
| 103 | MAB124 | MAB124.0.sugarcane|gb157|CA284042_T1 | sugarcane | 293 | | |
| 104 | | MAB124.1.sugarcane|gb157.2|CA284042_T1 | sugarcane | 294 | updated to production gb157.2 | updated to production gb157.2 |
| 105 | MAB125 | MAB125.0.rice|gb157|CF957213_T1 | rice | 295 | | |
| 106 | | MAB125.1.rice|gb157.2|CF957213_T1 | rice | 296 | updated to production gb157.2 | updated to production gb157.2 |
| 107 | MAB126 | MAB126.0.grape|gb157|BQ797309_T1 | grape | 297 | | |
| 108 | | MAB126.1.grape|gb160|BQ797309_T1 | grape | 298 | updated to production gb160 | updated to production gb160 |
| 109 | MAB127 | MAB127.0.grape|gb157|CB971532_T1 | grape | 299 | | |
| 110 | | MAB127.1.grape|gb160|CB971532_T1 | grape | 300 | updated to production gb160 | updated to production gb160 |
| 111 | MAB128 | MAB128.0.sugarcane|gb157|CA142162_T1 | sugarcane | 301 | | |
| 112 | | MAB128.1.sugarcane|gb157.2|CA142162_T1 | sugarcane | 302 | updated to production gb157.2 | updated to production gb157.2 |
| 113 | MAB129 | MAB129.0.tomato|gb157|AI486106_T1 | tomato | 303 | | |
| 114 | | MAB129.1.tomato|gb164|AI486106_T1 | tomato | 304 | updated to production gb164 | updated to production gb164 |
| 115 | MAB130 | MAB130.0.canola|gb157|CD829694_T1 | canola | 305 | | |
| 116 | MAB131 | MAB131.0.tomato|gb157|AW928843_T1 | tomato | 306 | | |
| 117 | | MAB131.1.tomato|gb164|AW928843_T1 | tomato | 307 | updated to production gb164 | updated to production gb164 |
| 118 | MAB132 | MAB132.0.barley|gb157|BF621624_T1 | barley | 308 | | |
| 119 | MAB133 | MAB133.0.barley|gb157|BE411546_T1 | barley | 309 | | |
| 120 | | MAB133.1.barley|gb157.2|BE411546_T1 | barley | 310 | updated to production gb157.2 | updated to production gb157.2 |

TABLE 1-continued

Identified ABST Genes

| SEQ ID NO: Polynucleotide | Gene Name | Cluster Name | Organism | SEQ ID NO: Polypeptide | Polynucleotide Description | Polypeptide Description |
|---|---|---|---|---|---|---|
| 121 | MAB134 | MAB134.0.barley\|gb157\|BE437407_T1 | barley | 311 | | |
| | | | | 312 | | protein Bioinformatics & Protein Curated |
| 122 | MAB135 | MAB135.0.lotus\|gb157\|AI967693_T1 | lotus | 313 | | |
| 123 | | MAB135.1.lotus\|gb157.2\|AI967693_T1 | lotus | 314 | updated to production gb157.2 | updated to production gb157.2 |
| 124 | MAB136 | MAB136.0.rice\|gb157\|AK058573_T1 | rice | 315 | | |
| 125 | | MAB136.1.rice\|gb157.2\|AK058573_T1 | rice | 316 | updated to production gb157.2 | updated to production gb157.2 |
| 126 | MAB137 | MAB137.0.barley\|gb157\|AL508624_T1 | barley | 317 | from provisional patent | |
| 127 | | MAB137.1.barley\|gb157.2\|AL508624_T1 | barley | 318 | updated to production gb157.2 | updated to production gb157.2 |
| 128 | MAB138 | MAB138.0.potato\|gb157\|BI177281_T1 | potato | 319 | from provisional patent | |
| 129 | | MAB138.1.potato\|gb157.2\|BI177281_T1 | potato | 320 | updated to production gb157.2 | updated to production gb157.2 |
| 130 | MAB139 | MAB139.0.cotton\|gb157.2\|AI727826_T1 | cotton | 321 | from provisional patent | |
| 131 | | MAB139.1.cotton\|gb164\|AI727826_T1 | cotton | 322 | updated to production gb164 | updated to production gb164 |
| 132 | MAB140 | MAB140.0.barley\|gb157\|BI778498_T1 | barley | 323 | from provisional patent | |
| 133 | | MAB140.1.barley\|gb157.2\|BI778498_T1 | barley | 324 | updated to production gb157.2 | updated to production gb157.2 |
| 134 | MAB141 | MAB141.0.barley\|gb157\|BE421008_T1 | barley | 325 | from provisional patent | |
| 135 | MAB142 | MAB142.0.cotton\|gb157.2\|AI055631_T2 | cotton | 326 | from provisional patent | |
| 136 | | MAB142.0.cotton\|gb157.2\|AI055631_T1 | cotton | 327 | from provisional patent | |
| 137 | | MAB142.1.cotton\|gb164\|AW187041_T1 | cotton | 328 | updated to production gb164 | updated to production gb164 |
| 138 | MAB143 | MAB143.0.tomato\|gb157\|AI487157_T1 | tomato | 329 | from provisional patent | |
| 139 | | MAB143.1.tomato\|gb164\|AI487157_T1 | tomato | 330 | updated to production gb164 | updated to production gb164 |
| 140 | MAB144 | MAB144.0.grape\|gb157\|CA814960_T1 | grape | 331 | from provisional patent | |
| 141 | | MAB144.1.grape\|gb160\|CA814960_T1 | grape | 332 | updated to production gb160 | updated to production gb160 |
| 142 | MAB145 | MAB145.0.barley\|gb157\|BE413365_T1 | barley | 333 | from provisional patent | |
| 143 | MAB146 | MAB146.0.tomato\|gb157\|AI773927_T1 | tomato | 334 | from provisional patent | |
| 144 | | MAB146.1.tomato\|gb164\|AI773927_T1 | tomato | 335 | updated to production gb164 | updated to production gb164 |
| 145 | MAB147 | MAB147.0.tobacco\|gb157\|EB446189_T1 | tobacco | 336 | | |

TABLE 1-continued

Identified ABST Genes

| SEQ ID NO: Polynucleotide | Gene Name | Cluster Name | Organism | SEQ ID NO: Polypeptide | Polynucleotide Description | Polypeptide Description |
|---|---|---|---|---|---|---|
| 146 | | MAB147.1.tobacco\|gb162\|EB446189_T1 | tobacco | 337 | updated to production gb162 | updated to production gb162 |
| 147 | MAB148 | MAB148.0.*medicago*\|gb157\|AW256654_T1 | *medicago* | 338 | | |
| 148 | | MAB148.1.*medicago*\|gb157.2\|AW256654_T1 | *medicago* | 339 | updated to production gb157.2 | updated to production gb157.2 |
| 149 | MAB150 | MAB150.0.canola\|gb157\|CD818831_T1 | canola | 340 | | |
| 150 | | MAB150.1.canola\|gb161\|CD818831_T1 | canola | 341 | updated to production gb161 | updated to production gb161 |
| 151 | MAB151 | MAB151.0.potato\|gb157\|BQ513540_T1 | potato | 342 | | |
| 152 | | MAB151.1.potato\|gb157.2\|BQ513540_T1 | potato | 343 | updated to production gb157.2 | updated to production gb157.2 |
| 153 | MAB152 | MAB152.0.grape\|gb157\|BQ798655_T1 | grape | 344 | | |
| 154 | | MAB152.1.grape\|gb160\|BQ798655_T1 | grape | 345 | updated to production gb160 | updated to production gb160 |
| 155 | MAB153 | MAB153.0.sugarcane\|gb157\|BQ533857_T1 | sugarcane | 346 | | |
| 156 | | MAB153.1.sugarcane\|gb157.2\|BQ533857_T1 | sugarcane | 347 | updated to production gb157.2 | updated to production gb157.2 |
| 157 | MAB154 | MAB154.0.sugarcane\|gb157\|BQ537570_T3 | sugarcane | 348 | | |
| 158 | | MAB154.0.sugarcane\|gb157\|BQ537570_T2 | sugarcane | 349 | | |
| 159 | | MAB154.0.sugarcane\|gb157\|BQ537570_T1 | sugarcane | 350 | | |
| 160 | | MAB154.1.sugarcane\|gb157.2\|BQ537570_T1 | sugarcane | 351 | updated to production gb157.2 | updated to production gb157.2 |
| 161 | MAB155 | MAB155.0.*sorghum*\|gb157\|AW676730_T1 | *sorghum* | 352 | | |
| 162 | | MAB155.1.*sorghum*\|gb161.xeno\|AW676730_T1 | *sorghum* | 353 | updated to production gb161.xeno | updated to production gb161.xeno |
| 163 | MAB156 | MAB156.0.tobacco\|gb157\|AB117525_T1 | tobacco | 354 | | |
| 164 | | MAB156.1.tobacco\|gb162\|AB117525_T1 | tobacco | 355 | updated to production gb162 | updated to production gb162 |
| 165 | MAB157 | MAB157.0.sugarcane\|gb157\|BQ533820_T2 | sugarcane | 356 | | |
| 166 | | MAB157.0.sugarcane\|gb157\|BQ533820_T1 | sugarcane | 357 | | |
| 167 | | MAB157.1.sugarcane\|gb157.2\|BQ533820_T1 | sugarcane | 358 | updated to production gb157.2 | updated to production gb157.2 |
| 168 | MAB158 | MAB158.0.cotton\|gb157.2\|AI054450_T1 | cotton | 359 | | |
| 169 | MAB159 | MAB159.0.canola\|gb157\|CD818468_T1 | canola | 360 | | |
| 170 | MAB160 | MAB160.0.barley\|gb157\|BF622450_T1 | barley | 361 | | |
| 171 | MAB161 | MAB161.0.poplar\|gb157\|BU896597_T1 | poplar | 362 | | |
| 172 | | MAB161.1.poplar\|gb157.2\|BU896597_T1 | poplar | 363 | updated to production gb157.2 | updated to production gb157.2 |
| 173 | MAB162 | MAB162.0.sugarcane\|gb157\|BU102611_T1 | sugarcane | 364 | | |
| 174 | | MAB162.1.sugarcane\|gb157.2\|BU102611_T1 | sugarcane | 365 | updated to production gb157.2 | updated to production gb157.2 |
| 175 | MAB163 | MAB163.0.barley\|gb157\|AL501813_T1 | barley | 366 | | |
| 176 | | MAB163.1.barley\|gb157.2\|AL501813_T1 | barley | 367 | updated to production gb157.2 | updated to production gb157.2 |
| 177 | MAB164 | MAB164.0.barley\|gb157\|BF253543_T1 | barley | 368 | | |
| 178 | | MAB164.1.barley\|gb157.2\|BF253543_T1 | barley | 369 | updated to production gb157.2 | updated to production gb157.2 |
| 179 | MAB165 | MAB165.0.grape\|gb157\|BQ793123_T1 | grape | 370 | | |
| 180 | MAB166 | MAB166.0.poplar\|gb157\|CV228694_T1 | poplar | 371 | | |

TABLE 1-continued

Identified ABST Genes

| SEQ ID NO: Polynucleotide | Gene Name | Cluster Name | Organism | SEQ ID NO: Polypeptide | Polynucleotide Description | Polypeptide Description |
|---|---|---|---|---|---|---|
| 181 | | MAB166.1.poplar\|gb157.2\|CV228694_T1 | poplar | 372 | updated to production gb157.2 | updated to production gb157.2 |
| 182 | MAB167 | MAB167.0.canola\|gb157\|CX278043_T1 | canola | 373 | | |
| 183 | | MAB167.1.canola\|gb161\|CX278043_T1 | canola | 374 | updated to production gb161 | updated to production gb161 |
| 184 | MAB168 | MAB168.0.grape\|gb157\|BG273815_T1 | grape | 375 | | |
| 185 | | MAB168.1.grape\|gb160\|BG273815_T1 | grape | 376 | updated to production gb160 | updated to production gb160 |
| 186 | MAB169 | MAB169.0.cotton\|gb157.2\|COTLEA14B_T1 | cotton | 377 | | |
| 187 | | MAB169.1.cotton\|gb164\|COTLEA14B_T1 | cotton | 378 | updated to production gb164 | updated to production gb164 |
| 188 | MAB170 | MAB170.0.barley\|gb157\|BE412505_T1 | barley | 379 | | |
| 189 | | MAB170.1.barley\|gb157.2\|BE412505_T1 | barley | 380 | updated to production gb157.2 | updated to production gb157.2 |
| 190 | MAB171 | MAB171.0.sugarcane\|gb157\|CA123631_T1 | sugarcane | 381 | | |
| 191 | | MAB171.1.sugarcane\|gb157.2\|CA123631_T1 | sugarcane | 382 | updated to production gb157.2 | updated to production gb157.2 |
| 192 | MAB172 | MAB172.0.sugarcane\|gb157\|BQ478980_T1 | sugarcane | 383 | | |
| 193 | | MAB172.0.sugarcane\|gb157\|BQ478980_T2 | sugarcane | 384 | | |
| 194 | MAB173 | MAB173.0.barley\|gb157\|BY836652_T1 | barley | 385 | | |
| 195 | | MAB173.1.barley\|gb157.2\|BY836652_T1 | barley | 386 | updated to production gb157.2 | updated to production gb157.2 |
| 196 | MAB174 | MAB174.0.barley\|gb157\|BG342904_T1 | barley | 387 | | |
| 197 | | MAB174.1.barley\|gb157.2\|BG342904_T1 | barley | 388 | updated to production gb157.2 | updated to production gb157.2 |
| 198 | MAB175 | MAB175.0.tomato\|gb157\|BG126606_T1 | tomato | 389 | | |
| 199 | | MAB175.0.tomato\|gb157\|BG126606_T2 | tomato | 390 | | |
| 200 | | MAB175.1.tomato\|gb164\|BG126606_T1 | tomato | 391 | updated to production gb164 | updated to production gb164 |
| 1653 | MAB66 | MAB66.0.tomato\|gb164\|BG124832_CT1 | tomato | 1651 | | |

Polynucleotides and polypeptides with significant homology to the identified ABST genes have been identified from the databases using BLAST software using the BlastX algorithm. The query nucleotide sequences were SEQ ID NOs:1, 3, 5, 7, 9, 10, 11, 13, 15, 16, 17, 19, 21, 23, 25, 26, 28, 29, 30, 32, 34, 36, 37, 38, 40, 42, 44, 46, 48, 50, 52, 54, 55, 57, 59, 61, 63, 65, 67, 69, 71, 73, 75, 77, 79, 81, 82, 84, 86, 88, 90, 91, 93, 94, 96, 98, 100, 101, 103, 105, 107, 109, 111, 113, 115, 116, 118, 119, 121, 122, 124, 126, 128, 130, 132, 134, 135, 138, 140, 142, 143, 145, 147, 149, 151, 153, 155, 157, 161, 163, 165, 168, 169, 170, 171, 173, 175, 177, 179, 180, 182, 184, 186, 188, 190, 192, 194, 196, 198 and 1653, and the identified ABST homologs are provided in Table 2, below.

TABLE 2

ABST Gene homologs

| Polynucleotide SEQ ID NO: | Cluster name | Organism | Polypeptide SEQ ID NO: | Homolog to a polypeptide encoded by polynucleotide SEQ ID NO. | % Global identity |
|---|---|---|---|---|---|
| 392 | apple\|gb157.3\|CN444532_T1 | apple | 961 | Seq357.MAB157.15.sugarcane | 85 |
| 393 | apple\|gb157.3\|CN445371_T1 | apple | 962 | Seq376.MAB168.15.grape | 87 |
| 394 | apple\|gb157.3\|CN878026_T1 | apple | 963 | Seq350.MAB154.15.sugarcane | 80 |
| 395 | apple\|gb157.3\|CK900582_T1 | apple | 964 | Seq321.MAB139.15.cotton | 85 |
| 396 | apple\|gb157.3\|CN888579_T2 | apple | 965 | Seq256.MAB37.15.tomato | 86 |
| 397 | apple\|gb157.3\|CN888579_T3 | apple | 966 | Seq256.MAB37.15.tomato | 81 |
| 398 | apple\|gb157.3\|CO066535_T1 | apple | 967 | Seq370.MAB165.15.grape | 84 |
| 399 | apple\|gb157.3\|CN888579_T1 | apple | 968 | Seq256.MAB37.15.tomato | 86 |

TABLE 2-continued

ABST Gene homologs

| Polynucleotide SEQ ID NO: | Cluster name | Organism | Polypeptide SEQ ID NO: | Homolog to a polypeptide encoded by polynucleotide SEQ ID NO. | % Global identity |
|---|---|---|---|---|---|
| 400 | apple\|gb157.3\|CN496860_T1 | apple | 969 | Seq321.MAB139.15.cotton | 81 |
| 401 | apricot\|gb157.2\|BQ134642_T1 | apricot | 970 | Seq329.MAB143.15.tomato | 82 |
| 402 | apricot\|gb157.2\|CB822088_T1 | apricot | 971 | Seq256.MAB37.15.tomato | 88 |
| 403 | aquilegia\|gb157.3\|DR915383_T1 | aquilegia | 972 | Seq321.MAB139.15.cotton | 83 |
| 404 | aquilegia\|gb157.3\|DR913600_T1 | aquilegia | 973 | Seq344.MAB152.15.grape | 83 |
| 405 | aquilegia\|gb157.3\|DR920101_T1 | aquilegia | 974 | Seq370.MAB165.15.grape | 87 |
| 406 | aquilegia\|gb157.3\|DT727583_T1 | aquilegia | 975 | Seq311.MAB134.15.barley | 80 |
| 407 | aquilegia\|gb157.3\|DR918523_T1 | aquilegia | 976 | Seq376.MAB168.15.grape | 82 |
| 408 | arabidopsis\|gb165\|AT1G67890_T2 | arabidopsis | 977 | Seq263.MAB42.15.sorghum | 80 |
| 409 | arabidopsis\|gb165\|AT1G78070_T2 | arabidopsis | 978 | Seq207.MAB6.15.arabidopsis | 97 |
| 410 | arabidopsis\|gb165\|AT1G52890_T3 | arabidopsis | 979 | Seq211.MAB9.15.arabidopsis | 85 |
| 411 | arabidopsis\|gb165\|AT3G06620_T1 | arabidopsis | 980 | Seq357.MAB157.15.sugarcane | 80 |
| 412 | arabidopsis\|gb165\|AT1G67890_T1 | arabidopsis | 981 | Seq263.MAB42.15.sorghum | 80 |
| 413 | arabidopsis\|gb165\|AT5G14860_T1 | arabidopsis | 982 | Seq341.MAB150.15.canola | 80 |
| 414 | arabidopsis\|gb165\|AT5G49470_T2 | arabidopsis | 983 | Seq263.MAB42.15.sorghum | 81 |
| 415 | arabidopsis\|gb165\|AT5G49470_T1 | arabidopsis | 984 | Seq263.MAB42.15.sorghum | 81 |
| 416 | arabidopsis\|gb165\|AT3G24170_T1 | arabidopsis | 985 | Seq376.MAB168.15.grape | 80 |
| 417 | arabidopsis\|gb165\|AT1G11670_T1 | arabidopsis | 986 | Seq229.MAB20.15.arabidopsis | 84 |
| 418 | arabidopsis\|gb165\|AT3G25230_T1 | arabidopsis | 987 | Seq370.MAB165.15.grape | 80 |
| 419 | arabidopsis\|gb165\|AT4G32500_T2 | arabidopsis | 988 | Seq242.MAB29.15.arabidopsis | 81 |
| 420 | arabidopsis\|gb165\|AT5G06760_T1 | arabidopsis | 989 | Seq373.MAB167.15.canola | 84 |
| 421 | arabidopsis\|gb165\|AT4G27410_T3 | arabidopsis | 990 | Seq211.MAB9.15.arabidopsis | 94 |
| 422 | arabidopsis\|gb165\|AT4G27560_T1 | arabidopsis | 991 | Seq254.MAB36.15.arabidopsis | 94 |
| 423 | artemisia\|gb164\|EY047508_T1 | artemisia | 992 | Seq321.MAB139.15.cotton | 80 |
| 424 | artemisia\|gb164\|EY060376_T1 | artemisia | 993 | Seq376.MAB168.15.grape | 85 |
| 425 | artemisia\|gb164\|EY089381_T1 | artemisia | 994 | Seq256.MAB37.15.tomato | 86 |
| 426 | artemisia\|gb164\|EY042537_T1 | artemisia | 995 | Seq349.MAB154.15.sugarcana | 80 |
| 427 | b_juncea\|gb164\|EVGN00102008310737_T1 | b_juncea | 996 | Seq360.MAB159.15.canola | 97 |
| 428 | b_juncea\|gb164\|EVGN08486004170336_T1 | b_juncea | 997 | Seq373.MAB167.15.canola | 94 |
| 429 | b_juncea\|gb164\|EVGN00429914360666_T1 | b_juncea | 998 | Seq370.MAB165.15.grape | 83 |
| 430 | b_juncea\|gb164\|EVGN00258430752139P1_T1 | b_juncea | 999 | Seq376.MAB168.15.grape | 80 |
| 431 | b_juncea\|gb164\|EVGN01568909822952_T1 | b_juncea | 1000 | Seq373.MAB167.15.canola | 98 |
| 432 | b_oleracea\|gb161\|DY029719_T1 | b_oleracea | 1001 | Seq370.MAB165.15.grape | 82 |
| 433 | b_oleracea\|gb161\|AM385106_T1 | b_oleracea | 1002 | Seq360.MAB159.15.canola | 96 |
| 434 | b_oleracea\|gb161\|AM387179_T1 | b_oleracea | 1003 | Seq360.MAB159.15.canola | 91 |
| 435 | b_oleracea\|gb161\|AM061306_T1 | b_oleracea | 1004 | Seq284.MAB1.00.15.arabidopsis | 86 |
| 436 | b_oleracea\|gb161\|AB125639_T1 | b_oleracea | 1005 | Seq376.MAB168.15.grape | 80 |
| 437 | b_rapa\|gb162\|EE523634_T1 | b_rapa | 1006 | Seq229.MAB20.15.arabidopsis | 92 |
| 438 | b_rapa\|gb162\|EX024909_T1 | b_rapa | 1007 | Seq217.MAB13.15.arabidopsis | 83 |
| 439 | b_rapa\|gb162\|EX070158_T2 | b_rapa | 1008 | Seq211.MAB9.15.arabidopsis | 95 |
| 440 | b_rapa\|gb162\|CA992067_T1 | b_rapa | 1009 | Seq360.MAB159.15.canola | 94 |
| 441 | b_rapa\|gb162\|EE520623_T1 | b_rapa | 1010 | Seq280.MAB91.10.arabidopsis | 89 |
| 442 | b_rapa\|gb162\|CV545896_T1 | b_rapa | 1011 | Seq208.MAB7.15.arabidopsis | 88 |
| 443 | b_rapa\|gb162\|CO749564_T1 | b_rapa | 1012 | Seq370.MAB165.15.grape | 82 |
| 444 | b_rapa\|gb162\|CV434105_T1 | b_rapa | 1013 | Seq217.MAB13.15.arabidopsis | 83 |
| 445 | b_rapa\|gb162\|AF008441_T1 | b_rapa | 1014 | Seq376.MAB168.15.grape | 80 |
| 446 | b_rapa\|gb162\|EX070158_T1 | b_rapa | 1015 | Seq211.MAB9.15.arabidopsis | 86 |
| 447 | b_rapa\|gb162\|EX088727_T1 | b_rapa | 1016 | Seq271.MAB46.15.arabidopsis | 93 |
| 448 | b_rapa\|gb162\|BG544469_T1 | b_rapa | 1017 | Seq360.MAB159.15.canola | 82 |
| 449 | b_rapa\|gb162\|DN962625_T1 | b_rapa | 1018 | Seq237.MAB25.15.arabidopsis | 85 |
| 450 | b_rapa\|gb162\|CV544672_T1 | b_rapa | 1019 | Seq284.MAB100.15.arabidosis | 88 |
| 451 | barley\|gb157.2\|BI947678_T1 | barley | 1020 | Seq368.MAB164.15.barley | 92 |
| 452 | barley\|gb157.2\|AV835424_T1 | barley | 1021 | Seq257.MAB38.15.wheat | 97 |
| 453 | barley\|gb157.2\|BE455969_T1 | barley | 1022 | Seq290.MAB122.15.maize | 84 |
| 454 | barley\|gb157.2\|BE519575_T2 | barley | 1023 | Seq263.MAB42.15.sorghum | 81 |
| 455 | barley\|gb157.2\|BF625959_T1 | barley | 1024 | Seq221.MAB15.15.sorghum | 83 |
| 456 | barley\|gb157.2\|BQ461470_T1 | barley | 1025 | Seq356.MAB157.15.sugarcane | 82 |
| 457 | basilicum\|gb157.3\|DY333033_T1 | basilicum | 1026 | Seq256.MAB37.15.tomato | 87 |
| 458 | bean\|gb164\|CB542809_T1 | bean | 1027 | Seq376.MAB168.15.grape | 80 |
| 459 | bean\|gb164\|CV529652_T1 | bean | 1028 | Seq370.MAB165.15.grape | 83 |
| 460 | bean\|gb164\|CB543453_T1 | bean | 1029 | Seq368.MAB164.15.barley | 80 |
| 461 | bean\|gb164\|CV535253_T1 | bean | 1030 | Seq256.MAB37.15.tomato | 88 |
| 462 | beet\|gb162\|BQ592516_T1 | beet | 1031 | Seq256.MAB37.15.tomato | 86 |
| 463 | beet\|gb162\|BQ488223_T1 | beet | 1032 | Seq211.MAB9.15.arabidopsis | 88 |
| 464 | beet\|gb162\|BQ583768_T1 | beet | 1033 | Seq385.MAB173.15.barley | 85 |
| 465 | beet\|gb162\|BQ591963_T1 | beet | 1034 | Seq368.MAB164.15.barley | 80 |
| 466 | brachypodium\|gb161.xeno\|BE519575_T1 | brachypodium | 1035 | Seq356.MAB157.15.sugarcane | 85 |
| 467 | brachypodium\|gb161.xeno\|BG368321_T1 | brachypodium | 1036 | Seq247.MAB32.15.rice | 81 |
| 468 | brachypodium\|gb161.xeno\|BE400652_T1 | brachypodium | 1037 | Seq368.MAB164.15.barley | 95 |
| 469 | brachypodium\|gb161.xeno\|AL502884_T1 | brachypodium | 1038 | Seq210.MAB8.15.rice | 82 |
| 470 | brachypodium\|gb161.xeno\|BY836652_T1 | brachypodium | 1039 | Seq385.MAB173.15.barley | 90 |
| 471 | brachypodium\|gb161.xeno\|BE414917_T1 | brachypodium | 1040 | Seq309.MAB133.15.barley | 93 |

TABLE 2-continued

ABST Gene homologs

| Polynucleotide SEQ ID NO: | Cluster name | Organism | Polypeptide SEQ ID NO: | Homolog to a polypeptide encoded by polynucleotide SEQ ID NO. | % Global identity |
|---|---|---|---|---|---|
| 472 | brachypodium\|gb161.xeno\|BF202085_T1 | brachypodium | 1041 | Seq291.MAB123.15.barley | 83 |
| 473 | brachypodium\|gb161.xeno\|BE406378_T1 | brachypodium | 1042 | Seq219.MAB14.15.rice | 80 |
| 474 | brachypodium\|gb161.xeno\|BE517562_T1 | brachypodium | 1043 | Seq366.MAB163.15.barley | 85 |
| 475 | brachypodium\|gb161.xeno\|BE420294_T1 | brachypodium | 1044 | Seq290.MAB122.15.maize | 85 |
| 476 | brachypodium\|gb161.xeno\|BG369416_T1 | brachypodium | 1045 | Seq270.MAB45.15.wheat | 89 |
| 477 | brachypodium\|gb161.xeno\|BE406039_T2 | brachypodium | 1046 | Seq241.MAB28.15.rice | 93 |
| 478 | brachypodium\|gb161.xeno\|BE418087_T1 | brachypodium | 1047 | Seq325.MAB141.15.barley | 86 |
| 479 | brachypodium\|gb161.xeno\|BE470780_T1 | brachypodium | 1048 | Seq221.MAB15.15.sorghum | 81 |
| 480 | brachypodium\|gb161.xeno\|AV835424_T1 | brachypodium | 1049 | Seq257.MAB38.15.wheat | 93 |
| 481 | brachypodium\|gb161.xeno\|BE398656_T1 | brachypodium | 1050 | Seq308.MAB132.15.barley | 93 |
| 482 | brachypodium\|gb161.xeno\|BE437407_T1 | brachypodium | 1051 | Seq311.MAB134.15.barley | 98 |
| 483 | brachypodium\|gb161.xeno\|BE406039_T3 | brachypodium | 1052 | Seq333.MAB145.15.barley | 81 |
| 484 | brachypodium\|gb161.xeno\|BE490408_T1 | brachypodium | 1053 | Seq264.MAB42.10.sorghum | 80 |
| 485 | brachypodium\|gb161.xeno\|BE403745_T1 | brachypodium | 1054 | Seq379.MAB170.15.barley | 92 |
| 486 | brachypodium\|gb161.xeno\|BE490591_T1 | brachypodium | 1055 | Seq366.MAB163.15.barley | 87 |
| 487 | brachypodium\|gb161.xeno\|BQ461470_T2 | brachypodium | 1056 | Seq356.MAB157.15.sugarcane | 85 |
| 488 | brachypodium\|gb161.xeno\|BE517562_T2 | brachypodium | 1057 | Seq366.MAB163.15.barley | 83 |
| 489 | brachypodium\|gb161.xeno\|BE413341_T1 | brachypodium | 1058 | Seq336.MAB147.15.tobacco | 80 |
| 490 | brachypodium\|gb161.xeno\|BE515529_T1 | brachypodium | 1059 | Seq259.MAB39.15.barley | 96 |
| 491 | brachypodium\|gb161.xeno\|DV471778_T1 | brachypodium | 1060 | Seq348.MAB154.15.sugarcane | 83 |
| 492 | canola\|gb161\|EL587045_T1 | canola | 1061 | Seq277.MAB50.15.arabidopsis | 87 |
| 493 | canola\|gb161\|CX279297_T1 | canola | 1062 | Seq280.MAB91.10.arabidopsis | 85 |
| 494 | canola\|gb161\|CD815143_T1 | canola | 1063 | Seq222.MAB16.15.rice | 80 |
| 495 | canola\|gb161\|CD831036_T1 | canola | 1064 | Seq284.MAB100.15.arabidopsis | 86 |
| 496 | canola\|gb161\|EE466962_T1 | canola | 1065 | Seq360.MAB159.15.canola | 83 |
| 497 | canola\|gb161\|CN726580_T1 | canola | 1066 | Seq305.MAB130.15.canola | 89 |
| 498 | canola\|gb161\|CD829644_T1 | canola | 1067 | Seq373.MAB167.15.canola | 86 |
| 499 | canola\|gb161\|AY245887_T1 | canola | 1068 | Seq211.MAB9.15.arabidopsis | 87 |
| 500 | canola\|gb161\|EE411591_T1 | canola | 1069 | Seq207.MAB6.15.arabidopsis | 88 |
| 501 | canola\|gb161\|DY020345_T1 | canola | 1070 | Seq211.MAB9.15.arabidopsis | 92 |
| 502 | canola\|gb161\|CD820718_T1 | canola | 1071 | Seq360.MAB159.15.canola | 95 |
| 503 | canola\|gb161\|CX189134_T1 | canola | 1072 | Seq221.MAB15.15.sorghum | 81 |
| 504 | canola\|gb161\|EG021120_T1 | canola | 1073 | Seq360.MAB159.15.canola | 83 |
| 505 | canola\|gb161\|ES906182_T1 | canola | 1074 | Seq244.MAB30.15.arabidopsis | 92 |
| 506 | canola\|gb161\|ES911977_T1 | canola | 1075 | Seq229.MAB20.15.arabidopsis | 88 |
| 507 | canola\|gb161\|CD814410_T1 | canola | 1076 | Seq217.MAB13.15.arabidopsis | 81 |
| 508 | canola\|gb161\|ES904177_T1 | canola | 1077 | Seq208.MAB7.15.arabidopsis | 87 |
| 509 | canola\|gb161\|CD813775_T1 | canola | 1078 | Seq370.MAB165.15.grape | 82 |
| 510 | canola\|gb161\|CD824419_T1 | canola | 1079 | Seq229.MAB20.15.arabidopsis | 94 |
| 511 | canola\|gb161\|CD825454_T1 | canola | 1080 | Seq229.MAB20.15.arabidopsis | 90 |
| 512 | canola\|gb161\|CD834184_T1 | canola | 1081 | Seq284.MAB100.15.arabidopsis | 88 |
| 513 | canola\|gb161\|EE469078_T1 | canola | 1082 | Seq370.MAB165.15.grape | 83 |
| 514 | canola\|gb161\|GFXAJ535111X1_T1 | canola | 1083 | Seq305.MAB130.15.canola | 99 |
| 515 | canola\|gb161\|EE448267_T1 | canola | 1084 | Seq222.MAB16.15.rice | 80 |
| 516 | canola\|gb161\|CX193415_T1 | canola | 1085 | Seq237.MAB25.15.arabidopsis | 85 |
| 517 | canola\|gb161\|CD813278_T1 | canola | 1086 | Seq375.MAB168.15.grape | 80 |
| 518 | castorbean\|gb160\|MDL28401M000077_T1 | castorbean | 1087 | Seq370.MAB165.15.grape | 86 |
| 519 | castorbean\|gb160\|EE258294_T1 | castorbean | 1088 | Seq256.MAB37.15.tomato | 87 |
| 520 | castorbean\|gb160\|MDL28066M000021_T1 | castorbean | 1089 | Seq370.MAB165.15.grape | 85 |
| 521 | castorbean\|gb160\|AM267339_T1 | castorbean | 1090 | Seq222.MAB16.15.rice | 80 |
| 522 | castorbean\|gb160\|EG659656_T1 | castorbean | 1091 | Seq376.MAB168.15.grape | 83 |
| 523 | castorbean\|gb160\|EG656754_T1 | castorbean | 1092 | Seq263.MAB42.15.sorghum | 82 |
| 524 | castorbean\|gb160\|EE259826_T1 | castorbean | 1093 | Seq362.MAB161.15.poplar | 83 |
| 525 | castorbean\|gb160\|EG659299_T1 | castorbean | 1094 | Seq300.MAB127.15.grape | 81 |
| 526 | castorbean\|gb160\|EE259565_T1 | castorbean | 1095 | Seq276.MAB49.15.maize | 80 |
| 527 | castorbean\|gb160\|EE255133_T1 | castorbean | 1096 | Seq321.MAB139.15.cotton | 84 |
| 528 | castorbean\|gb160\|MDL29822M003364_T1 | castorbean | 1097 | Seq336.MAB147.15.tobacco | 82 |
| 529 | castorbean\|gb160\|EG661241_T1 | castorbean | 1098 | Seq371.MAB166.15.poplar | 85 |
| 530 | centaurea\|gb161\|EH713943_T1 | centaurea | 1099 | Seq321.MAB139.15.cotton | 82 |
| 531 | centaurea\|gb161\|EH724589_T1 | centaurea | 1100 | Seq256.MAB37.15.tomato | 84 |
| 532 | centaurea\|gb161\|EH717520_T1 | centaurea | 1101 | Seq329.MAB143.15.tomato | 80 |
| 533 | centaurea\|gb161\|EH711566_T1 | centaurea | 1102 | Seq370.MAB165.15.grape | 81 |
| 534 | centaurea\|gb161\|EH713337_T1 | centaurea | 1103 | Seq259.MAB39.15.barley | 81 |
| 535 | centaurea\|gb161\|EH713628_T1 | centaurea | 1104 | Seq376.MAB168.15.grape | 83 |
| 536 | centaurea\|gb161\|EH738263_T1 | centaurea | 1105 | Seq385.MAB173.15.barley | 80 |
| 537 | centaurea\|gb161\|EH727723_T1 | centaurea | 1106 | Seq256.MAB37.15.tomato | 84 |
| 538 | cichorium\|gb161\|DT212291_T1 | cichorium | 1107 | Seq370.MAB165.15.grape | 80 |
| 539 | cichorium\|gb161\|DT211081_T1 | cichorium | 1108 | Seq376.MAB168.15.grape | 83 |
| 540 | cichorium\|gb161\|EH692437_T1 | cichorium | 1109 | Seq256.MAB37.15.tomato | 86 |
| 541 | cichorium\|gb161\|DT212218_T1 | cichorium | 1110 | Seq256.MAB37.15.tomato | 89 |
| 542 | citrus\|gb157.2\|CB290836_T1 | citrus | 1111 | Seq376.MAB168.15.grape | 85 |
| 543 | citrus\|gb157.2\|BQ624861_T1 | citrus | 1112 | Seq276.MAB49.15.maize | 82 |

TABLE 2-continued

ABST Gene homologs

| Polynucleotide SEQ ID NO: | Cluster name | Organism | Polypeptide SEQ ID NO: | Homolog to a polypeptide encoded by polynucleotide SEQ ID NO. | % Global identity |
|---|---|---|---|---|---|
| 544 | citrus\|gb157.2\|BQ624727_T1 | citrus | 1113 | Seq370.MAB165.15.grape | 85 |
| 545 | citrus\|gb157.2\|CB290836_T2 | citrus | 1114 | Seq376.MAB168.15.grape | 86 |
| 546 | citrus\|gb157.2\|CX672218_T2 | citrus | 1115 | Seq357.MAB157.15.sugarcane | 83 |
| 547 | citrus\|gb157.2\|CF504250_T1 | citrus | 1116 | Seq222.MAB16.15.rice | 82 |
| 548 | citrus\|gb157.2\|CK933948_T1 | citrus | 1117 | Seq256.MAB37.15.tomato | 86 |
| 549 | clover\|gb162\|BB926896_T1 | clover | 1118 | Seq256.MAB37.15.tomato | 82 |
| 550 | clover\|gb162\|BB904696_T1 | clover | 1119 | Seq263.MAB42.15.sorghum | 84 |
| 551 | coffea\|gb157.2\|DV676382_T1 | coffea | 1120 | Seq256.MAB37.15.tomato | 91 |
| 552 | coffea\|gb157.2\|DV688680_T1 | coffea | 1121 | Seq332.MAB144.15.grape | 83 |
| 553 | coffea\|gb157.2\|DQ124044_T1 | coffea | 1122 | Seq303.MAB129.15.tomato | 80 |
| 554 | cotton\|gb164\|BF268276_T1 | cotton | 1123 | Seq370.MAB165.15.grape | 84 |
| 555 | cotton\|gb164\|CO113031_T1 | cotton | 1124 | Seq319.MAB138.15.potato | 80 |
| 556 | cotton\|gb164\|AI730186_T1 | cotton | 1125 | Seq256.MAB37.15.tomato | 81 |
| 557 | cotton\|gb164\|CO103100_T1 | cotton | 1126 | Seq256.MAB37.15.tomato | 86 |
| 558 | cotton\|gb164\|BE051970_T1 | cotton | 1127 | Seq370.MAB165.15.grape | 84 |
| 559 | cotton\|gb164\|AI725698_T1 | cotton | 1128 | Seq376.MAB168.15.grape | 85 |
| 560 | cotton\|gb164\|AI728290_T1 | cotton | 1129 | Seq370.MAB165.15.grape | 82 |
| 561 | cotton\|gb164\|AI055482_T1 | cotton | 1130 | Seq370.MAB165.15.grape | 85 |
| 562 | cotton\|gb164\|ES794517_T1 | cotton | 1131 | Seq327.MAB142.15.cotton | 81 |
| 563 | cotton\|gb164\|BF268276_T2 | cotton | 1132 | Seq370.MAB165.15.grape | 84 |
| 564 | cotton\|gb164\|CO109448_T1 | cotton | 1133 | Seq376.MAB168.15.grape | 83 |
| 565 | cotton\|gb164\|DT459182_T1 | cotton | 1134 | Seq375.MAB168.15.grape | 84 |
| 566 | cotton\|gb164\|BG441162_T1 | cotton | 1135 | Seq256.MAB37.15.tomato | 85 |
| 567 | cowpea\|gb165\|FF390508_T1 | cowpea | 1136 | Seq256.MAB37.15.tomato | 84 |
| 568 | cowpea\|gb165\|FF390203_T1 | cowpea | 1137 | Seq259.MAB39.15.barley | 86 |
| 569 | cowpea\|gb165\|DQ267475_T1 | cowpea | 1138 | Seq376.MAB168.15.grape | 83 |
| 570 | cowpea\|gb165\|FF382851_T1 | cowpea | 1139 | Seq224.MAB17.15.soybean | 89 |
| 571 | cowpea\|gb165\|FF394009_T1 | cowpea | 1140 | Seq370.MAB165.15.grape | 85 |
| 572 | dandelion\|gb161\|DQ160099_T1 | dandelion | 1141 | Seq376.MAB168.15.grape | 82 |
| 573 | dandelion\|gb161\|DY823013_T1 | dandelion | 1142 | Seq256.MAB37.15.tomato | 82 |
| 574 | dandelion\|gb161\|DY820394_T2 | dandelion | 1143 | Seq256.MAB37.15.tomato | 88 |
| 575 | dandelion\|gb161\|DY813450_T2 | dandelion | 1144 | Seq256.MAB37.15.tomato | 85 |
| 576 | dandelion\|gb161\|DY820394_T1 | dandelion | 1145 | Seq256.MAB37.15.tomato | 87 |
| 577 | fescue\|gb161\|DT687914_T1 | fescue | 1146 | Seq290.MAB122.15.maize | 93 |
| 578 | fescue\|gb161\|DT702477_T1 | fescue | 1147 | Seq291.MAB123.15.barley | 87 |
| 579 | fescue\|gb161\|DT705881_T1 | fescue | 1148 | Seq311.MAB134.15.barley | 96 |
| 580 | fescue\|gb161\|DT682501_T1 | fescue | 1149 | Seq321.MAB139.15.cotton | 82 |
| 581 | fescue\|gb161\|DT699000_T1 | fescue | 1150 | Seq309.MAB133.15.barley | 90 |
| 582 | fescue\|gb161\|DT706685_T1 | fescue | 1151 | Seq259.MAB39.15.barley | 96 |
| 583 | fescue\|gb161\|DT698326_T1 | fescue | 1152 | Seq368.MAB164.15.barley | 95 |
| 584 | fescue\|gb161\|DT677453_T1 | fescue | 1153 | Seq379.MAB170.15.barley | 95 |
| 585 | fescue\|gb161\|DT674734_T1 | fescue | 1154 | Seq333.MAB145.15.barley | 88 |
| 586 | ginger\|gb164\|DY377113_T1 | ginger | 1155 | Seq223.MAB16.15.rice | 81 |
| 587 | grape\|gb160\|BQ792651_T1 | grape | 1156 | Seq222.MAB16.15.rice | 84 |
| 588 | grape\|gb160\|BQ793581_T1 | grape | 1157 | Seq371.MAB166.15.poplar | 80 |
| 589 | iceplant\|gb164\|BM658279_T1 | iceplant | 1158 | Seq376.MAB168.15.grape | 83 |
| 590 | iceplant\|gb164\|BE034140_T1 | iceplant | 1159 | Seq303.MAB129.15.tomato | 81 |
| 591 | ipomoea\|gb157.2\|AU224303_T1 | ipomoea | 1160 | Seq256.MAB37.15.tomato | 91 |
| 592 | ipomoea\|gb157.2\|AU224807_T1 | ipomoea | 1161 | Seq385.MAB173.15.barley | 80 |
| 593 | ipomoea\|gb157.2\|CJ758382_T1 | ipomoea | 1162 | Seq371.MAB166.15.poplar | 83 |
| 594 | lettuce\|gb157.2\|DW048067_T1 | lettuce | 1163 | Seq256.MAB37.15.tomato | 87 |
| 595 | lettuce\|gb157.2\|DW046482_T1 | lettuce | 1164 | Seq256.MAB37.15.tomato | 85 |
| 596 | lettuce\|gb157.2\|DW062524_T1 | lettuce | 1165 | Seq259.MAB39.15.barley | 81 |
| 597 | lettuce\|gb157.2\|DW048641_T1 | lettuce | 1166 | Seq370.MAB165.15.grape | 80 |
| 598 | lettuce\|gb157.2\|DW055618_T1 | lettuce | 1167 | Seq371.MAB166.15.poplar | 80 |
| 599 | lettuce\|gb157.2\|DY961700_T2 | lettuce | 1168 | Seq211.MAB9.15.arabidopsis | 83 |
| 600 | lettuce\|gb157.2\|DW075962_T1 | lettuce | 1169 | Seq256.MAB37.15.tomato | 87 |
| 601 | lettuce\|gb157.2\|DW047202_T1 | lettuce | 1170 | Seq376.MAB168.15.grape | 83 |
| 602 | lotus\|gb157.2\|BF177835_T1 | lotus | 1171 | Seq256.MAB37.15.tomato | 90 |
| 603 | lotus\|gb157.2\|BW601503_T1 | lotus | 1172 | Seq211.MAB9.15.arabidopsis | 84 |
| 604 | maize\|gb164\|T15319_T2 | maize | 1173 | Seq276.MAB49.15.maize | 96 |
| 605 | maize\|gb164\|AI649734_T1 | maize | 1174 | Seq264.MAB42.10.sorghum | 90 |
| 606 | maize\|gb164\|BE638692_T1 | maize | 1175 | Seq228.MAB19.15.sorghum | 88 |
| 607 | maize\|gb164\|AW498283_T1 | maize | 1176 | Seq210.MAB8.15.rice | 80 |
| 608 | maize\|gb164\|AI622375_T1 | maize | 1177 | Seq309.MAB133.15.barley | 90 |
| 609 | maize\|gb164\|BQ034409_T1 | maize | 1178 | Seq290.MAB122.15.maize | 100 |
| 610 | maize\|gb164\|EC895235_T1 | maize | 1179 | Seq210.MAB8.15.rice | 86 |
| 611 | maize\|gb164\|AI947795_T2 | maize | 1180 | Seq325.MAB141.15.barley | 80 |
| 612 | maize\|gb164\|AI947974_T1 | maize | 1181 | Seq227.MAB19.15.sorghum | 93 |
| 613 | maize\|gb164\|AI619086_T1 | maize | 1182 | Seq346.MAB153.15.sugarcane | 95 |
| 614 | maize\|gb164\|AA143925_T1 | maize | 1183 | Seq221.MAB15.15.sorghum | 94 |
| 615 | maize\|gb164\|AW179463_T1 | maize | 1184 | Seq321.MAB139.15.cotton | 82 |

TABLE 2-continued

ABST Gene homologs

| Polynucleotide SEQ ID NO: | Cluster name | Organism | Polypeptide SEQ ID NO: | Homolog to a polypeptide encoded by polynucleotide SEQ ID NO. | % Global identity |
|---|---|---|---|---|---|
| 616 | maize\|gb164\|BE051802_T1 | maize | 1185 | Seq231.MAB21.15.rice | 89 |
| 617 | maize\|gb164\|AI942091_T1 | maize | 1186 | Seq309.MAB133.15.barley | 89 |
| 618 | maize\|gb164\|AI944064_T1 | maize | 1187 | Seq383.MAB172.15.sugarcane | 96 |
| 619 | maize\|gb164\|T15319_T1 | maize | 1188 | Seq276.MAB49.15.maize | 96 |
| 620 | maize\|gb164\|AI782993_T1 | maize | 1189 | Seq241.MAB28.15.rice | 82 |
| 621 | maize\|gb164\|T26945_T1 | maize | 1190 | Seq370.MAB165.15.grape | 80 |
| 622 | maize\|gb164\|AI941749_T1 | maize | 1191 | Seq269.MAB45.15.wheat | 91 |
| 623 | maize\|gb164\|AI891255_T1 | maize | 1192 | Seq311.MAB134.15.barley | 95 |
| 624 | maize\|gb164\|CD975046_T1 | maize | 1193 | Seq203.MAB3.15.rice | 88 |
| 625 | maize\|gb164\|AW360563_T1 | maize | 1194 | Seq241.MAB28.15.rice | 81 |
| 626 | maize\|gb164\|AI901860_T1 | maize | 1195 | Seq259.MAB39.15.barley | 85 |
| 627 | maize\|gb164\|AI948098_T1 | maize | 1196 | Seq381.MAB171.15.sugarcane | 95 |
| 628 | maize\|gb164\|AI444730_T1 | maize | 1197 | Seq241.MAB28.15.rice | 83 |
| 629 | maize\|gb164\|AW216308_T1 | maize | 1198 | Seq288.MAB121.15.sugarcane | 89 |
| 630 | maize\|gb164\|BM268089_T1 | maize | 1199 | Seq381.MAB171.15.sugarcane | 92 |
| 631 | maize\|gb164\|AI438597_T1 | maize | 1200 | Seq352.MAB155.15.sorghum | 91 |
| 632 | maize\|gb164\|AW927739_T1 | maize | 1201 | Seq350.MAB154.15.sugarcane | 97 |
| 633 | maize\|gb164\|AI891255_T2 | maize | 1202 | Seq311.MAB134.15.barley | 95 |
| 634 | maize\|gb164\|AI920760_T1 | maize | 1203 | Seq286.MAB104.15.rice | 89 |
| 635 | medicago\|gb157.2\|AI974487_T1 | medicago | 1204 | Seq370.MAB165.15.grape | 87 |
| 636 | medicago\|gb157.2\|BE325770_T1 | medicago | 1205 | Seq256.MAB37.15.tomato | 88 |
| 637 | medicago\|gb157.2\|AW685603_T1 | medicago | 1206 | Seq376.MAB168.15.grape | 82 |
| 638 | medicago\|gb157.2\|AL368329_T1 | medicago | 1207 | Seq311.MAB134.15.barley | 80 |
| 639 | medicago\|gb157.2\|AW688497_T1 | medicago | 1208 | Seq370.MAB165.15.grape | 80 |
| 640 | medicago\|gb157.2\|AL377093_T1 | medicago | 1209 | Seq224.MAB17.15.soybean | 80 |
| 641 | medicago\|gb157.2\|AI974241_T1 | medicago | 1210 | Seq334.MAB146.15.tomato | 83 |
| 642 | medicago\|gb157.2\|BF632135_T1 | medicago | 1211 | Seq344.MAB152.15.grape | 85 |
| 643 | melon\|gb165\|DV633691_T1 | melon | 1212 | Seq376.MAB168.15.grape | 80 |
| 644 | melon\|gb165\|DV632564_T1 | melon | 1213 | Seq368.MAB164.15.barley | 80 |
| 645 | melon\|gb165\|DV633584_T1 | melon | 1214 | Seq344.MAB152.15.grape | 86 |
| 646 | melon\|gb165\|AM714958_T1 | melon | 1215 | Seq259.MAB39.15.barley | 81 |
| 647 | nicotiana_benthamiana\|gb162\|EH364164_T1 | nicotiana_benthamiana | 1216 | Seq256.MAB37.15.tomato | 95 |
| 648 | oat\|gb164\|CN816769_T1 | oat | 1217 | Seq368.MAB164.15.barley | 94 |
| 649 | oat\|gb164\|BE439108_T1 | oat | 1218 | Seq312.MAB134.10.barley | 85 |
| 650 | onion\|gb162\|CF437899_T1 | onion | 1219 | Seq256.MAB37.15.tomato | 81 |
| 651 | onion\|gb162\|CF437716_T1 | onion | 1220 | Seq276.MAB49.15.maize | 82 |
| 652 | onion\|gb162\|CF439314_T1 | onion | 1221 | Seq370.MAB165.15.grape | 80 |
| 653 | papaya\|gb165\|EX245596_T1 | papaya | 1222 | Seq370.MAB165.15.grape | 88 |
| 654 | papaya\|gb165\|EX299345_T1 | papaya | 1223 | Seq263.MAB42.15.sorghum | 82 |
| 655 | papaya\|gb165\|EX248971_T1 | papaya | 1224 | Seq362.MAB161.15.poplar | 86 |
| 656 | papaya\|gb165\|EX227965_T1 | papaya | 1225 | Seq332.MAB144.15.grape | 83 |
| 657 | papaya\|gb165\|EX264060_T1 | papaya | 1226 | Seq376.MAB168.15.grape | 89 |
| 658 | papaya\|gb165\|EX291966_T1 | papaya | 1227 | Seq370.MAB165.15.grape | 82 |
| 659 | peach\|gb157.2\|BU039922_T1 | peach | 1228 | Seq300.MAB127.15.grape | 82 |
| 660 | peach\|gb157.2\|BU039373_T1 | peach | 1229 | Seq370.MAB165.15.grape | 83 |
| 661 | peach\|gb157.2\|AJ631618_T1 | peach | 1230 | Seq276.MAB49.15.maize | 80 |
| 662 | peach\|gb157.2\|BU040470_T1 | peach | 1231 | Seq376.MAB168.15.grape | 89 |
| 663 | peach\|gb157.2\|BU039381_T1 | peach | 1232 | Seq256.MAB37.15.tomato | 88 |
| 664 | peanut\|gb161\|ES754023_T1 | peanut | 1233 | Seq332.MAB144.15.grape | 80 |
| 665 | peanut\|gb161\|EH043199_T1 | peanut | 1234 | Seq256.MAB37.15.tomato | 88 |
| 666 | pepper\|gb157.2\|BM063531_T1 | pepper | 1235 | Seq256.MAB37.15.tomato | 96 |
| 667 | pepper\|gb157.2\|BM062846_T1 | pepper | 1236 | Seq221.MAB15.15.sorghum | 82 |
| 668 | pepper\|gb157.2\|BM061776_T1 | pepper | 1237 | Seq329.MAB143.15.tomato | 90 |
| 669 | pepper\|gb157.2\|BM064151_T1 | pepper | 1238 | Seq306.MAB131.15.tomato | 88 |
| 670 | pepper\|gb157.2\|BM061313_T1 | pepper | 1239 | Seq211.MAB9.15.arabidopsis | 86 |
| 671 | pepper\|gb157.2\|BI480604_T1 | pepper | 1240 | Seq276.MAB49.15.maize | 80 |
| 672 | periwinkle\|gb164\|EG559012_T1 | periwinkle | 1241 | Seq259.MAB39.15.barley | 80 |
| 673 | petunia\|gb157.2\|CV292753_T1 | petunia | 1242 | Seq263.MAB42.15.sorghum | 80 |
| 674 | petunia\|gb157.2\|CV298220_T1 | petunia | 1243 | Seq283.MAB99.15.tomato | 81 |
| 675 | pine\|gb157.2\|DR088714_T1 | pine | 1244 | Seq357.MAB157.15.sugarcane | 80 |
| 676 | pine\|gb157.2\|AW290504_T1 | pine | 1245 | Seq344.MAB152.15.grape | 82 |
| 677 | pineapple\|gb157.2\|CO731309_T1 | pineapple | 1246 | Seq222.MAB16.15.rice | 83 |
| 678 | pineapple\|gb157.2\|DT336648_T1 | pineapple | 1247 | Seq376.MAB168.15.grape | 81 |
| 679 | pineapple\|gb157.2\|CO731994_T1 | pineapple | 1248 | Seq219.MAB14.15.rice | 80 |
| 680 | poplar\|gb157.2\|AI162293_T1 | poplar | 1249 | Seq298.MAB126.15.grape | 82 |
| 681 | poplar\|gb157.2\|AI165439_T1 | poplar | 1250 | Seq298.MAB126.15.grape | 80 |
| 682 | poplar\|gb157.2\|AI162293_T3 | poplar | 1251 | Seq298.MAB126.15.grape | 80 |
| 683 | poplar\|gb157.2\|BI120274_T3 | poplar | 1252 | Seq256.MAB37.15.tomato | 81 |
| 684 | poplar\|gb157.2\|BI120274_T2 | poplar | 1253 | Seq344.MAB152.15.grape | 89 |
| 685 | poplar\|gb157.2\|BF299457_T1 | poplar | 1254 | Seq370.MAB165.15.grape | 85 |
| 686 | poplar\|gb157.2\|BI120274_T1 | poplar | 1255 | Seq344.MAB152.15.grape | 86 |

TABLE 2-continued

ABST Gene homologs

| Polynucleotide SEQ ID NO: | Cluster name | Organism | Polypeptide SEQ ID NO: | Homolog to a polypeptide encoded by polynucleotide SEQ ID NO. | % Global identity |
|---|---|---|---|---|---|
| 687 | poplar\|gb157.2\|BI122516_T1 | poplar | 1256 | Seq362.MAB161.15.poplar | 90 |
| 688 | poplar\|gb157.2\|BU821689_T1 | poplar | 1257 | Seq321.MAB139.15.cotton | 81 |
| 689 | poplar\|gb157.2\|AI166955_T1 | poplar | 1258 | Seq344.MAB152.15.grape | 87 |
| 690 | poplar\|gb157.2\|BI069450_T1 | poplar | 1259 | Seq376.MAB168.15.grape | 85 |
| 691 | potato\|gb157.2\|BG594910_T1 | potato | 1260 | Seq370.MAB165.15.grape | 82 |
| 692 | potato\|gb157.2\|AJ487418_T1 | potato | 1261 | Seq321.MAB139.15.cotton | 82 |
| 693 | potato\|gb157.2\|BQ516076_T2 | potato | 1262 | Seq389.MAB175.15.tomato | 97 |
| 694 | potato\|gb157.2\|BE921143_T1 | potato | 1263 | Seq349.MAB154.15.sugarcane | 80 |
| 695 | potato\|gb157.2\|BG592541_T1 | potato | 1264 | Seq256.MAB37.15.tomato | 90 |
| 696 | potato\|gb157.2\|BF052848_T1 | potato | 1265 | Seq321.MAB139.15.cotton | 81 |
| 697 | potato\|gb157.2\|BF460150_T1 | potato | 1266 | Seq370.MAB165.15.grape | 84 |
| 698 | potato\|gb157.2\|BG097985_T1 | potato | 1267 | Seq303.MAB129.15.tomato | 91 |
| 699 | potato\|gb157.2\|BE923564_T1 | potato | 1268 | Seq342.MAB151.15.potato | 90 |
| 700 | potato\|gb157.2\|X86021_T1 | potato | 1269 | Seq334.MAB146.15.tomato | 97 |
| 701 | potato\|gb157.2\|BG594768_T1 | potato | 1270 | Seq329.MAB143.15.tomato | 97 |
| 702 | potato\|gb157.2\|BF154203_T1 | potato | 1271 | Seq256.MAB37.15.tomato | 98 |
| 703 | potato\|gb157.2\|BE344306_T1 | potato | 1272 | Seq357.MAB157.15.sugarcane | 82 |
| 704 | potato\|gb157.2\|BF460309_T1 | potato | 1273 | Seq329.MAB143.15.tomato | 98 |
| 705 | potato\|gb157.2\|BQ516076_T1 | potato | 1274 | Seq390.MAB175.15.tomato | 96 |
| 706 | potato\|gb157.2\|BI176616_T1 | potato | 1275 | Seq256.MAB37.15.tomato | 88 |
| 707 | potato\|gb157.2\|BQ117692_T1 | potato | 1276 | Seq354.MAB156.15.tobacco | 86 |
| 708 | potato\|gb157.2\|AJ487418_T2 | potato | 1277 | Seq321.MAB139.15.cotton | 81 |
| 709 | potato\|gb157.2\|BG351229_T1 | potato | 1278 | Seq357.MAB157.15.sugarcane | 81 |
| 710 | potato\|gb157.2\|AJ487418_T3 | potato | 1279 | Seq321.MAB139.15.cotton | 84 |
| 711 | potato\|gb157.2\|BF154154_T1 | potato | 1280 | Seq256.MAB37.15.tomato | 99 |
| 712 | radish\|gb164\|EY895633_T1 | radish | 1281 | Seq373.MAB167.15.canola | 93 |
| 713 | radish\|gb164\|EX772944_T1 | radish | 1282 | Seq356.MAB157.15.sugarcane | 83 |
| 714 | radish\|gb164\|EW725846_T1 | radish | 1283 | Seq237.MAB25.15.arabidopsis | 84 |
| 715 | radish\|gb164\|EV527306_T1 | radish | 1284 | Seq229.MAB20.15.arabidopsis | 94 |
| 716 | radish\|gb164\|EV565850_T1 | radish | 1285 | Seq277.MAB50.15.arabidopsis | 90 |
| 717 | radish\|gb164\|EX772722_T1 | radish | 1286 | Seq360.MAB159.15.canola | 8 |
| 718 | radish\|gb164\|EX775718_T1 | radish | 1287 | Seq376.MAB168.15.grape | 81 |
| 719 | radish\|gb164\|EV535278_T1 | radish | 1288 | Seq360.MAB159.15.canola | 81 |
| 720 | radish\|gb164\|EV565334_T1 | radish | 1289 | Seq211.MAB9.15.arabidopsis | 91 |
| 721 | radish\|gb164\|EV528083_T1 | radish | 1290 | Seq252.MAB35.15.arabidopsis | 80 |
| 722 | radish\|gb164\|T25168_T1 | radish | 1291 | Seq376.MAB168.15.grape | 80 |
| 723 | radish\|gb164\|EV544010_T1 | radish | 1292 | Seq229.MAB20.15.arabidopsis | 91 |
| 724 | radish\|gb164\|EW713752_T1 | radish | 1293 | Seq373.MAB167.15.canola | 86 |
| 725 | radish\|gb164\|EV568565_T1 | radish | 1294 | Seq284.MAB100.15.arabidopsis | 88 |
| 726 | radish\|gb164\|EV543867_T1 | radish | 1295 | Seq373.MAB167.15.canola | 88 |
| 727 | radish\|gb164\|EX770974_T1 | radish | 1296 | Seq211.MAB9.15.arabidopsis | 85 |
| 728 | radish\|gb164\|EV566819_T1 | radish | 1297 | Seq217.MAB13.15.arabidopsis | 81 |
| 729 | rice\|gb157.2\|NM001059403_T1 | rice | 1298 | Seq261.MAB40.15.rice | 84 |
| 730 | rice\|gb157.2\|C28755_T1 | rice | 1299 | Seq321.MAB139.15.cotton | 80 |
| 731 | rice\|gb157.2\|AA750806_T1 | rice | 1300 | Seq290.MAB122.15.maize | 83 |
| 732 | rice\|gb157.2\|AA751345_T1 | rice | 1301 | Seq321.MAB139.15.cotton | 80 |
| 733 | rice\|gb157.2\|BE040195_T6 | rice | 1302 | Seq346.MAB153.15.sugarcane | 95 |
| 734 | rice\|gb157.2\|BI118752_T1 | rice | 1303 | Seq276.MAB49.15.maize | 94 |
| 735 | rice\|gb157.2\|AW070148_T1 | rice | 1304 | Seq350.MAB154.15.sugarcane | 87 |
| 736 | rice\|gb157.2\|AW069929_T1 | rice | 1305 | Seq309.MAB133.15.barley | 93 |
| 737 | rice\|gb157.2\|AW070094_T1 | rice | 1306 | Seq274.MAB48.15.rice | 83 |
| 738 | rice\|gb157.2\|AA753115_T4 | rice | 1307 | Seq259.MAB39.15.barley | 90 |
| 739 | rice\|gb157.2\|BI795037_T4 | rice | 1308 | Seq385.MAB173.15.barley | 100 |
| 740 | rice\|gb157.2\|AU092454_T1 | rice | 1309 | Seq274.MAB48.15.rice | 100 |
| 741 | rice\|gb157.2\|AA753115_T3 | rice | 1310 | Seq259.MAB39.15.barley | 91 |
| 742 | rice\|gb157.2\|BE040195_T1 | rice | 1311 | Seq346.MAB153.15.sugarcane | 91 |
| 743 | rice\|gb157.2\|CB624284_T1 | rice | 1312 | Seq264.MAB42.10.sorghum | 82 |
| 744 | rice\|gb157.2\|AU030125_T3 | rice | 1313 | Seq357.MAB157.15.sugarcane | 88 |
| 745 | rice\|gb157.2\|AU164313_T1 | rice | 1314 | Seq270.MAB45.15.wheat | 84 |
| 746 | rice\|gb157.2\|BI799463_T1 | rice | 1315 | Seq221.MAB15.15.sorghum | 85 |
| 747 | rice\|gb157.2\|AW070094_T3 | rice | 1316 | Seq274.MAB48.15.rice | 80 |
| 748 | rice\|gb157.2\|AA753115_T1 | rice | 1317 | Seq259.MAB39.15.barley | 91 |
| 749 | rice\|gb157.2\|AU093322_T2 | rice | 1318 | Seq228.MAB19.15.sorghum | 85 |
| 750 | rice\|gb157.2\|AU030125_T1 | rice | 1319 | Seq263.MAB42.15.sorghum | 80 |
| 751 | rice\|gb157.2\|AA752703_T1 | rice | 1320 | Seq295.MAB125.15.rice | 88 |
| 752 | rice\|gb157.2\|NM001067464_T1 | rice | 1321 | Seq205.MAB4.15.rice | 93 |
| 753 | rice\|gb157.2\|NM001052309_T1 | rice | 1322 | Seq295.MAB125.15.rice | 91 |
| 754 | rice\|gb157.2\|CA763128_T2 | rice | 1323 | Seq219.MAB14.15.rice | 80 |
| 755 | rice\|gb157.2\|AW070148_T2 | rice | 1324 | Seq348.MAB154.15.sugarcane | 87 |
| 756 | rice\|gb157.2\|AU093322_T1 | rice | 1325 | Seq228.MAB19.15.sorghum | 86 |
| 757 | rice\|gb157.2\|AA753115_T5 | rice | 1326 | Seq259.MAB39.15.barley | 94 |
| 758 | rice\|gb157.2\|AU030125_T4 | rice | 1327 | Seq263.MAB42.15.sorghum | 80 |

TABLE 2-continued

ABST Gene homologs

| Polynucleotide SEQ ID NO: | Cluster name | Organism | Polypeptide SEQ ID NO: | Homolog to a polypeptide encoded by polynucleotide SEQ ID NO. | % Global identity |
|---|---|---|---|---|---|
| 759 | rye\|gb164\|BF429408_T1 | rye | 1328 | Seq309.MAB133.15.barley | 97 |
| 760 | rye\|gb164\|BE494847_T1 | rye | 1329 | Seq368.MAB164.15.barley | 97 |
| 761 | safflower\|gb162\|EL373402_T1 | safflower | 1330 | Seq376.MAB168.15.grape | 81 |
| 762 | safflower\|gb162\|EL374175_T1 | safflower | 1331 | Seq259.MAB39.15.barley | 83 |
| 763 | safflower\|gb162\|EL377332_T1 | safflower | 1332 | Seq385.MAB173.15.barley | 81 |
| 764 | safflower\|gb162\|EL373487_T1 | safflower | 1333 | Seq263.MAB42.15.sorghum | 80 |
| 765 | safflower\|gb162\|EL374095_T1 | safflower | 1334 | Seq256.MAB37.15.tomato | 86 |
| 766 | safflower\|gb162\|EL382051_T1 | safflower | 1335 | Seq256.MAB37.15.tomato | 86 |
| 767 | safflower\|gb162\|EL409148_T1 | safflower | 1336 | Seq385.MAB173.15.barley | 80 |
| 768 | sorghum\|gb161.xeno\|AW224927_T1 | sorghum | 1337 | Seq288.MAB121.15.sugarcane | 94 |
| 769 | sorghum\|gb161.xeno\|T26945_T2 | sorghum | 1338 | Seq370.MAB165.15.grape | 81 |
| 770 | sorghum\|gb161.xeno\|AI932179_T3 | sorghum | 1339 | Seq286.MAB104.15.rice | 91 |
| 771 | sorghum\|gb161.xeno\|T15319_T1 | sorghum | 1340 | Seq276.MAB49.15.maize | 97 |
| 772 | sorghum\|gb161.xeno\|AI615215_T1 | sorghum | 1341 | Seq248.MAB33.15.maize | 92 |
| 773 | sorghum\|gb161.xeno\|BG102066_T2 | sorghum | 1342 | Seq290.MAB122.15.maize | 90 |
| 774 | sorghum\|gb161.xeno\|AW672419_T2 | sorghum | 1343 | Seq276.MAB49.15.maize | 97 |
| 775 | sorghum\|gb161.xeno\|AW672419_T3 | sorghum | 1344 | Seq276.MAB49.15.maize | 95 |
| 776 | sorghum\|gb161.xeno\|AI901860_T1 | sorghum | 1345 | Seq259.MAB39.15.barley | 84 |
| 777 | sorghum\|gb161.xeno\|AI621995_T3 | sorghum | 1346 | Seq384.MAB172.15.sugarcane | 97 |
| 778 | sorghum\|gb161.xeno\|AI881418_T2 | sorghum | 1347 | Seq264.MAB42.10.sorghum | 100 |
| 779 | sorghum\|gb161.xeno\|AI891255_T1 | sorghum | 1348 | Seq311.MAB134.15.barley | 95 |
| 780 | sorghum\|gb161.xeno\|AI782993_T1 | sorghum | 1349 | Seq241.MAB28.15.rice | 84 |
| 781 | sorghum\|gb161.xeno\|AI724629_T1 | sorghum | 1350 | Seq350.MAB154.15.sugarcane | 99 |
| 782 | sorghum\|gb161.xeno\|AA143925_T1 | sorghum | 1351 | Seq221.MAB15.15.sorghum | 100 |
| 783 | sorghum\|gb161.xeno\|AI621995_T2 | sorghum | 1352 | Seq383.MAB172.15.sugarcane | 99 |
| 784 | sorghum\|gb161.xeno\|T26945_T1 | sorghum | 1353 | Seq370.MAB165.15.grape | 81 |
| 785 | sorghum\|gb161.xeno\|AW179463_T1 | sorghum | 1354 | Seq321.MAB139.15.cotton | 80 |
| 786 | sorghum\|gb161.xeno\|ZMU90944_T2 | sorghum | 1355 | Seq367.MAB163.15.barley | 80 |
| 787 | sorghum\|gb161.xeno\|T15319_T2 | sorghum | 1356 | Seq276.MAB49.15.maize | 95 |
| 788 | sorghum\|gb161.xeno\|AI621995_T1 | sorghum | 1357 | Seq383.MAB172.15.sugarcane | 99 |
| 789 | sorghum\|gb161.xeno\|AI932179_T1 | sorghum | 1358 | Seq286.MAB104.15.rice | 90 |
| 790 | sorghum\|gb161.xeno\|AI621995_T4 | sorghum | 1359 | Seq383.MAB172.15.sugarcane | 99 |
| 791 | sorghum\|gb161.xeno\|ZMU90944_T3 | sorghum | 1360 | Seq367.MAB163.15.barley | 80 |
| 792 | sorghum\|gb161.xeno\|AI665229_T2 | sorghum | 1361 | Seq346.MAB153.15.sugarcane | 96 |
| 793 | sorghum\|gb161.xeno\|AI939836_T1 | sorghum | 1362 | Seq309.MAB133.15.barley | 92 |
| 794 | sorghum\|gb161.xeno\|BI099068_T1 | sorghum | 1363 | Seq270.MAB45.15.wheat | 83 |
| 795 | sorghum\|gb161.xeno\|AI665229_T1 | sorghum | 1364 | Seq346.MAB153.15.sugarcane | 96 |
| 796 | sorghum\|gb161.xeno\|AW672419_T1 | sorghum | 1365 | Seq276.MAB49.15.maize | 97 |
| 797 | sorghum\|gb161.xeno\|AW498283_T1 | sorghum | 1366 | Seq210.MAB8.15.rice | 83 |
| 798 | sorghum\|gb161.xeno\|AW923775_T1 | sorghum | 1367 | Seq231.MAB21.15.rice | 88 |
| 799 | sorghum\|gb161.xeno\|T15319_T3 | sorghum | 1368 | Seq276.MAB49.15.maize | 85 |
| 800 | soybean\|gb162\|BG839539_T1 | soybean | 1369 | Seq368.MAB164.15.barley | 80 |
| 801 | soybean\|gb162\|CA783290_T1 | soybean | 1370 | Seq259.MAB39.15.barley | 81 |
| 802 | soybean\|gb162\|BU551043_T1 | soybean | 1371 | Seq256.MAB37.15.tomato | 88 |
| 803 | soybean\|gb162\|EV282184_T1 | soybean | 1372 | Seq371.MAB166.15.poplar | 82 |
| 804 | soybean\|gb162\|BI967468_T1 | soybean | 1373 | Seq368.MAB164.15.barley | 80 |
| 805 | soybean\|gb162\|BI321879_T1 | soybean | 1374 | Seq259.MAB39.15.barley | 81 |
| 806 | soybean\|gb162\|AW132704_T1 | soybean | 1375 | Seq256.MAB37.15.tomato | 90 |
| 807 | soybean\|gb162\|BU764498_T1 | soybean | 1376 | Seq256.MAB37.15.tomato | 86 |
| 808 | soybean\|gb162\|CA953156_T1 | soybean | 1377 | Seq298.MAB126.15.grape | 80 |
| 809 | soybean\|gb162\|CF922618_T1 | soybean | 1378 | Seq259.MAB39.15.barley | 84 |
| 810 | soybean\|gb162\|BU544425_T1 | soybean | 1379 | Seq357.MAB157.15.sugarcane | 81 |
| 811 | soybean\|gb162\|BU765332_T1 | soybean | 1380 | Seq233.MAB22.15.tomato | 80 |
| 812 | soybean\|gb162\|CA936077_T1 | soybean | 1381 | Seq376.MAB168.15.grape | 83 |
| 813 | soybean\|gb162\|BE823013_T1 | soybean | 1382 | Seq376.MAB168.15.grape | 83 |
| 814 | soybean\|gb162\|CD417415_T1 | soybean | 1383 | Seq370.MAB165.15.grape | 85 |
| 815 | soybean\|gb162\|BE660691_T1 | soybean | 1384 | Seq362.MAB161.15.poplar | 81 |
| 816 | soybean\|gb162\|CD395628_T1 | soybean | 1385 | Seq370.MAB165.15.grape | 82 |
| 817 | soybean\|gb162\|BU549206_T2 | soybean | 1386 | Seq259.MAB39.15.barley | 80 |
| 818 | soybean\|gb162\|AW351120_T1 | soybean | 1387 | Seq298.MAB126.15.grape | 82 |
| 819 | soybean\|gb162\|AW132704_T2 | soybean | 1388 | Seq256.MAB37.15.tomato | 90 |
| 820 | soybean\|gb162\|BE584244_T1 | soybean | 1389 | Seq256.MAB37.15.tomato | 91 |
| 821 | spruce\|gb162\|CO234968_T1 | spruce | 1390 | Seq344.MAB152.15.grape | 83 |
| 822 | spurge\|gb161\|DV146052_T1 | spurge | 1391 | Seq357.MAB157.15.sugarcane | 81 |
| 823 | spurge\|gb161\|DV127024_T1 | spurge | 1392 | Seq344.MAB152.15.grape | 83 |
| 824 | spurge\|gb161\|DV124157_T1 | spurge | 1393 | Seq376.MAB168.15.grape | 85 |
| 825 | strawberry\|gb164\|EX683450_T1 | strawberry | 1394 | Seq348.MAB154.15.sugarcane | 81 |
| 826 | strawberry\|gb164\|EX683265_T1 | strawberry | 1395 | Seq370.MAB165.15.grape | 81 |
| 827 | strawberry\|gb164\|DY675409_T1 | strawberry | 1396 | Seq256.MAB37.15.tomato | 81 |
| 828 | sugarcane\|gb157.2\|CA115287_T1 | sugarcane | 1397 | Seq357.MAB157.15.sugarcane | 88 |
| 829 | sugarcane\|gb157.2\|CA216001_T1 | sugarcane | 1398 | Seq259.MAB39.15.barley | 85 |
| 830 | sugarcane\|gb157.2\|CA072819_T1 | sugarcane | 1399 | Seq241.MAB28.15.rice | 83 |

TABLE 2-continued

ABST Gene homologs

| Polynucleotide SEQ ID NO: | Cluster name | Organism | Polypeptide SEQ ID NO: | Homolog to a polypeptide encoded by polynucleotide SEQ ID NO. | % Global identity |
|---|---|---|---|---|---|
| 831 | sugarcane\|gb157.2\|CA125036_T1 | sugarcane | 1400 | Seq291.MAB123.15.barley | 82 |
| 832 | sugarcane\|gb157.2\|CA071646_T1 | sugarcane | 1401 | Seq286.MAB104.15.rice | 90 |
| 833 | sugarcane\|gb157.2\|CA117936_T2 | sugarcane | 1402 | Seq228.MAB19.15.sorghum | 93 |
| 834 | sugarcane\|gb157.2\|BQ537163_T1 | sugarcane | 1403 | Seq276.MAB49.15.maize | 96 |
| 835 | sugarcane\|gb157.2\|CA074253_T1 | sugarcane | 1404 | Seq241.MAB28.15.rice | 83 |
| 836 | sugarcane\|gb157.2\|CA102030_T1 | sugarcane | 1405 | Seq385.MAB173.15.barley | 85 |
| 837 | sugarcane\|gb157.2\|CA068084_T1 | sugarcane | 1406 | Seq366.MAB163.15.barley | 80 |
| 838 | sugarcane\|gb157.2\|CA233048_T1 | sugarcane | 1407 | Seq290.MAB122.15.maize | 80 |
| 839 | sugarcane\|gb157.2\|CA090429_T1 | sugarcane | 1408 | Seq288.MAB121.15.sugarcane | 95 |
| 840 | sugarcane\|gb157.2\|CA095299_T1 | sugarcane | 1409 | Seq370.MAB165.15.grape | 80 |
| 841 | sugarcane\|gb157.2\|BQ533298_T1 | sugarcane | 1410 | Seq311.MAB134.15.barley | 95 |
| 842 | sugarcane\|gb157.2\|CA107649_T1 | sugarcane | 1411 | Seq248.MAB33.15.maize | 90 |
| 843 | sugarcane\|gb157.2\|BQ536274_T1 | sugarcane | 1412 | Seq231.MAB21.15.rice | 88 |
| 844 | sugarcane\|gb157.2\|CA117936_T1 | sugarcane | 1413 | Seq228.MAB19.15.sorghum | 94 |
| 845 | sugarcane\|gb157.2\|BQ533234_T1 | sugarcane | 1414 | Seq221.MAB15.15.sorghum | 99 |
| 846 | sugarcane\|gb157.2\|CA072307_T1 | sugarcane | 1415 | Seq309.MAB133.15.barley | 93 |
| 847 | sugarcane\|gb157.2\|CA073476_T1 | sugarcane | 1416 | Seq290.MAB122.15.maize | 91 |
| 848 | sugarcane\|gb157.2\|CA065809_T1 | sugarcane | 1417 | Seq366.MAB163.15.barley | 80 |
| 849 | sugarcane\|gb157.2\|CA072307_T2 | sugarcane | 1418 | Seq309.MAB133.15.barley | 93 |
| 850 | sunflower\|gb162\|DY909111_T1 | sunflower | 1419 | Seq336.MAB147.15.tobacco | 83 |
| 851 | sunflower\|gb162\|DY941035_T1 | sunflower | 1420 | Seq376.MAB168.15.grape | 82 |
| 852 | sunflower\|gb162\|CD857487_T1 | sunflower | 1421 | Seq370.MAB165.15.grape | 81 |
| 853 | sunflower\|gb162\|DY942252_T1 | sunflower | 1422 | Seq311.MAB134.15.barley | 80 |
| 854 | sunflower\|gb162\|CD850784_T1 | sunflower | 1423 | Seq256.MAB37.15.tomato | 83 |
| 855 | sunflower\|gb162\|BQ968872_T1 | sunflower | 1424 | Seq357.MAB157.15.sugarcane | 83 |
| 856 | sunflower\|gb162\|EE616266_T1 | sunflower | 1425 | Seq256.MAB37.15.tomato | 84 |
| 857 | sunflower\|gb162\|EE641694_T1 | sunflower | 1426 | Seq256.MAB37.15.tomato | 84 |
| 858 | sunflower\|gb162\|DY924220_T1 | sunflower | 1427 | Seq259.MAB39.15.barley | 81 |
| 859 | sunflower\|gb162\|DY910907_T1 | sunflower | 1428 | Seq370.MAB165.15.grape | 80 |
| 860 | sunflower\|gb162\|AY029172_T1 | sunflower | 1429 | Seq321.MAB139.15.cotton | 81 |
| 861 | sunflower\|gb162\|DY909077_T1 | sunflower | 1430 | Seq321.MAB139.15.cotton | 80 |
| 862 | sunflower\|gb162\|DY921635_T1 | sunflower | 1431 | Seq376.MAB168.15.grape | 83 |
| 863 | sunflower\|gb162\|DY913894_T1 | sunflower | 1432 | Seq256.MAB37.15.tomato | 82 |
| 864 | switchgrass\|gb165\|FE608718_T1 | switchgrass | 1433 | Seq370.MAB165.15.grape | 81 |
| 865 | switchgrass\|gb165\|FE624581_T1 | switchgrass | 1434 | Seq333.MAB145.15.barley | 87 |
| 866 | switchgrass\|gb165\|FE604798_T1 | switchgrass | 1435 | Seq269.MAB45.15.wheat | 90 |
| 867 | switchgrass\|gb165\|DN151012_T1 | switchgrass | 1436 | Seq309.MAB133.15.barley | 90 |
| 868 | switchgrass\|gb165\|FE619903_T1 | switchgrass | 1437 | Seq383.MAB172.15.sugarcane | 95 |
| 869 | switchgrass\|gb165\|DN144676_T1 | switchgrass | 1438 | Seq385.MAB173.15.barley | 87 |
| 870 | switchgrass\|gb165\|FE609872_T1 | switchgrass | 1439 | Seq228.MAB19.15.sorghum | 89 |
| 871 | switchgrass\|gb165\|FE617860_T1 | switchgrass | 1440 | Seq381.MAB171.15.sugarcane | 88 |
| 872 | switchgrass\|gb165\|DN145750_T1 | switchgrass | 1441 | Seq221.MAB15.15.sorghum | 95 |
| 873 | switchgrass\|gb165\|FE597811_T1 | switchgrass | 1442 | Seq248.MAB33.15.maize | 83 |
| 874 | switchgrass\|gb165\|FE647199_T1 | switchgrass | 1443 | Seq381.MAB171.15.sugarcane | 90 |
| 875 | switchgrass\|gb165\|DN145034_T1 | switchgrass | 1444 | Seq276.MAB49.15.maize | 95 |
| 876 | switchgrass\|gb165\|FE617335_T1 | switchgrass | 1445 | Seq286.MAB104.15.rice | 91 |
| 877 | switchgrass\|gb165\|FE597809_T1 | switchgrass | 1446 | Seq350.MAB154.15.sugarcane | 95 |
| 878 | switchgrass\|gb165\|FE597811_T2 | switchgrass | 1447 | Seq248.MAB33.15.maize | 85 |
| 879 | switchgrass\|gb165\|FE635691_T1 | switchgrass | 1448 | Seq311.MAB134.15.barley | 95 |
| 880 | switchgrass\|gb165\|FE653022_T1 | switchgrass | 1449 | Seq385.MAB173.15.barley | 83 |
| 881 | switchgrass\|gb165\|DN144793_T1 | switchgrass | 1450 | Seq259.MAB39.15.barley | 90 |
| 882 | switchgrass\|gb165\|FE641674_T1 | switchgrass | 1451 | Seq309.MAB133.15.barley | 89 |
| 883 | thellungiella\|gb157.2\|DN775606_T1 | thellungiella | 1452 | Seq212.MAB10.15.arabidopsis | 82 |
| 884 | thellungiella\|gb157.2\|DN773228_T1 | thellungiella | 1453 | Seq211.MAB9.15.arabidopsis | 98 |
| 885 | thellungiella\|gb157.2\|DN772771_T1 | thellungiella | 1454 | Seq208.MAB7.15.arabidopsis | 89 |
| 886 | thellungiella\|gb157.2\|DN774422_T1 | thellungiella | 1455 | Seq360.MAB159.15.canola | 83 |
| 887 | thellungiella\|gb157.2\|DN774140_T1 | thellungiella | 1456 | Seq284.MAB100.15.arabidopsis | 86 |
| 888 | tobacco\|gb162\|DW003503_T1 | tobacco | 1457 | Seq329.MAB143.15.tomato | 93 |
| 889 | tobacco\|gb162\|BP532373_T1 | tobacco | 1458 | Seq357.MAB157.15.sugarcane | 82 |
| 890 | tobacco\|gb162\|CN949739_T1 | tobacco | 1459 | Seq370.MAB165.15.grape | 84 |
| 891 | tobacco\|gb162\|BQ843111_T1 | tobacco | 1460 | Seq319.MAB138.15.potato | 90 |
| 892 | tobacco\|gb162\|EB683054_T1 | tobacco | 1461 | Seq307.MAB131.15.tomato | 89 |
| 893 | tobacco\|gb162\|EB428197_T1 | tobacco | 1462 | Seq222.MAB16.15.rice | 80 |
| 894 | tobacco\|gb162\|EB445060_T1 | tobacco | 1463 | Seq283.MAB99.15.tomato | 90 |
| 895 | tobacco\|gb162\|EB447202_T1 | tobacco | 1464 | Seq390.MAB175.15.tomato | 88 |
| 896 | tobacco\|gb162\|DW001113_T1 | tobacco | 1465 | Seq256.MAB37.15.tomato | 88 |
| 897 | tobacco\|gb162\|EH623692_T1 | tobacco | 1466 | Seq303.MAB129.15.tomato | 85 |
| 898 | tomato\|gb164\|BG127210_T1 | tomato | 1467 | Seq342.MAB151.15.potato | 82 |
| 899 | tomato\|gb164\|BG128089_T2 | tomato | 1468 | Seq222.MAB16.15.rice | 80 |
| 900 | tomato\|gb164\|AW219181_T1 | tomato | 1469 | Seq256.MAB37.15.tomato | 90 |
| 901 | tomato\|gb164\|BG127288_T1 | tomato | 1470 | Seq370.MAB165.15.grape | 83 |
| 902 | tomato\|gb164\|BG133509_T1 | tomato | 1471 | Seq256.MAB37.15.tomato | 88 |

TABLE 2-continued

ABST Gene homologs

| Polynucleotide SEQ ID NO: | Cluster name | Organism | Polypeptide SEQ ID NO: | Homolog to a polypeptide encoded by polynucleotide SEQ ID NO. | % Global identity |
|---|---|---|---|---|---|
| 903 | tomato\|gb164\|BG131241_T1 | tomato | 1472 | Seq309.MAB133.15.barley | 80 |
| 904 | tomato\|gb164\|BG129621_T1 | tomato | 1473 | Seq350.MAB154.15.sugarcane | 80 |
| 905 | tomato\|gb164\|AI779004_T1 | tomato | 1474 | Seq309.MAB133.15.barley | 81 |
| 906 | tomato\|gb164\|BG129572_T1 | tomato | 1475 | Seq321.MAB139.15.cotton | 80 |
| 907 | tomato\|gb164\|BG135408_T1 | tomato | 1476 | Seq319.MAB138.15.potato | 98 |
| 908 | triphysaria\|gb164\|DR173028_T1 | triphysaria | 1477 | Seq329.MAB143.15.tomato | 81 |
| 909 | triphysaria\|gb164\|BM357524_T2 | triphysaria | 1478 | Seq283.MAB99.15.tomato | 85 |
| 910 | triphysaria\|gb164\|EY133838_T1 | triphysaria | 1479 | Seq311.MAB134.15.barley | 80 |
| 911 | triphysaria\|gb164\|BM357406_T1 | triphysaria | 1480 | Seq329.MAB143.15.tomato | 83 |
| 912 | triphysaria\|gb164\|BM357011_T1 | triphysaria | 1481 | Seq259.MAB39.15.barley | 80 |
| 913 | triphysaria\|gb164\|BM357524_T1 | triphysaria | 1482 | Seq376.MAB168.15.grape | 85 |
| 914 | triphysaria\|gb164\|EY137290_T1 | triphysaria | 1483 | Seq256.MAB37.15.tomato | 88 |
| 915 | wheat\|gb164\|CA484259_T1 | wheat | 1484 | Seq241.MAB28.15.rice | 84 |
| 916 | wheat\|gb164\|BE606422_T1 | wheat | 1485 | Seq379.MAB170.15.barley | 96 |
| 917 | wheat\|gb164\|BE406378_T1 | wheat | 1486 | Seq219.MAB14.15.rice | 80 |
| 918 | wheat\|gb164\|BE470780_T1 | wheat | 1487 | Seq221.MAB15.15.sorghum | 84 |
| 919 | wheat\|gb164\|BE418087_T1 | wheat | 1488 | Seq325.MAB141.15.barley | 95 |
| 920 | wheat\|gb164\|BQ294643_T1 | wheat | 1489 | Seq269.MAB45.15.wheat | 94 |
| 921 | wheat\|gb164\|BE415314_T1 | wheat | 1490 | Seq250.MAB34.15.barley | 82 |
| 922 | wheat\|gb164\|AL822647_T1 | wheat | 1491 | Seq259.MAB39.15.barley | 98 |
| 923 | wheat\|gb164\|BE406667_T1 | wheat | 1492 | Seq250.MAB34.15.barley | 89 |
| 924 | wheat\|gb164\|BF475039_T1 | wheat | 1493 | Seq221.MAB15.15.sorghum | 83 |
| 925 | wheat\|gb164\|CK196180_T1 | wheat | 1494 | Seq323.MAB140.15.barley | 80 |
| 926 | wheat\|gb164\|BE403745_T1 | wheat | 1495 | Seq379.MAB170.15.barley | 97 |
| 927 | wheat\|gb164\|BQ620260_T1 | wheat | 1496 | Seq311.MAB134.15.barley | 100 |
| 928 | wheat\|gb164\|BM138204_T1 | wheat | 1497 | Seq333.MAB145.15.barley | 91 |
| 929 | wheat\|gb164\|BE401114_T1 | wheat | 1498 | Seq291.MAB123.15.barley | 94 |
| 930 | wheat\|gb164\|BE498161_T1 | wheat | 1499 | Seq388.MAB174.15.barley | 93 |
| 931 | wheat\|gb164\|BQ744502_T1 | wheat | 1500 | Seq250.MAB34.15.barley | 85 |
| 932 | wheat\|gb164\|BE415172_T1 | wheat | 1501 | Seq366.MAB163.15.barley | 94 |
| 933 | wheat\|gb164\|CD490875_T1 | wheat | 1502 | Seq276.MAB49.15.maize | 97 |
| 934 | wheat\|gb164\|CA625741_T1 | wheat | 1503 | Seq309.MAB133.15.barley | 87 |
| 935 | wheat\|gb164\|BE443720_T1 | wheat | 1504 | Seq318.MAB137.15.barley | 94 |
| 936 | wheat\|gb164\|BE420294_T1 | wheat | 1505 | Seq290.MAB122.15.maize | 84 |
| 937 | wheat\|gb164\|BE516581_T1 | wheat | 1506 | Seq387.MAB174.15.barley | 95 |
| 938 | wheat\|gb164\|BE406039_T1 | wheat | 1507 | Seq333.MAB145.15.barley | 90 |
| 939 | wheat\|gb164\|BM136483_T1 | wheat | 1508 | Seq333.MAB145.15.barley | 92 |
| 940 | wheat\|gb164\|BE425976_T1 | wheat | 1509 | Seq250.MAB34.15.barley | 81 |
| 941 | wheat\|gb164\|CN011148_T1 | wheat | 1510 | Seq270.MAB45.15.wheat | 84 |
| 942 | wheat\|gb164\|BE419039_T1 | wheat | 1511 | Seq250.MAB34.15.barley | 80 |
| 943 | wheat\|gb164\|CA603413_T1 | wheat | 1512 | Seq323.MAB140.15.barley | 85 |
| 944 | wheat\|gb164\|CA743309_T1 | wheat | 1513 | Seq321.MAB139.15.cotton | 80 |
| 945 | wheat\|gb164\|BG262336_T1 | wheat | 1514 | Seq366.MAB163.15.barley | 94 |
| 946 | wheat\|gb164\|CD881765_T1 | wheat | 1515 | Seq219.MAB14.15.rice | 80 |
| 947 | wheat\|gb164\|BE352629_T1 | wheat | 1516 | Seq291.MAB123.15.barley | 96 |
| 948 | wheat\|gb164\|BE398656_T1 | wheat | 1517 | Seq308.MAB132.15.barley | 97 |
| 949 | wheat\|gb164\|BE403195_T1 | wheat | 1518 | Seq291.MAB123.15.barley | 94 |
| 950 | wheat\|gb164\|BE488904_T1 | wheat | 1519 | Seq367.MAB163.15.barley | 91 |
| 951 | wheat\|gb164\|BE492528_T1 | wheat | 1520 | Seq311.MAB134.15.barley | 100 |
| 952 | wheat\|gb164\|BE427383_T1 | wheat | 1521 | Seq219.MAB14.15.rice | 80 |
| 953 | wheat\|gb164\|CA646957_T1 | wheat | 1522 | Seq250.MAB34.15.barley | 89 |
| 954 | wheat\|gb164\|BE443720_T2 | wheat | 1523 | Seq318.MAB137.15.barley | 92 |
| 955 | wheat\|gb164\|BE490408_T1 | wheat | 1524 | Seq264.MAB42.10.sorghum | 81 |
| 956 | wheat\|gb164\|BE420295_T1 | wheat | 1525 | Seq379.MAB170.15.barley | 96 |
| 957 | wheat\|gb164\|AL825998_T1 | wheat | 1526 | Seq308.MAB132.15.barley | 97 |
| 958 | wheat\|gb164\|CA693465_T1 | wheat | 1527 | Seq308.MAB132.15.barley | 97 |
| 959 | wheat\|gb164\|BE585772_T1 | wheat | 1528 | Seq366.MAB163.15.barley | 95 |
| 960 | wheat\|gb164\|CA613914_T1 | wheat | 1529 | Seq356.MAB157.15.sugarcane | 84 |
| 1656 | >tomato\|gb164\|BG129621_T1 | tomato | 1660 | Seq1649.MAB66.tomato | 82 |
| 1657 | potato\|gb157.2\|BE921143_T1 | potato | 1661 | Seq1649.MAB66.tomato | 82 |
| 1658 | pepper\|gb157.2\|BM061807_T1 | pepper | 1662 | Seq1649.MAB66.tomato | 80 |
| 1659 | >triphysaria\|gb164\|BM357011_T1 | triphysaria | 1663 | Seq1649.MAB66.tomato | 80 |

Table 2:
* - Homology was calculated as % of identity over the aligned sequences. The query sequences were polynucleotide sequences SEQ ID NOs: 1, 3, 5, 7, 9, 10, 11, 13, 15, 16, 17, 19, 21, 23, 25, 26, 28, 29, 30, 32, 34, 36, 37, 38, 40, 42, 44, 46, 48, 50, 52, 54, 55, 57, 59, 61, 63, 65, 67, 69, 71, 73, 75, 77, 79, 81, 82, 84, 86, 88, 90, 91, 93, 94, 96, 98, 100, 101, 103, 105, 107, 109, 111, 113, 115, 116, 118, 119, 121, 122, 124, 126, 128, 130, 132, 134, 135, 138, 140, 142, 143, 145, 147, 149, 151, 153, 155, 157, 161, 163, 165, 168, 169, 170, 171, 173, 175, 177, 179, 180, 182, 184, 186, 188, 190, 192, 194, 196, 198 and 1649, and the subject sequences are protein sequences identified in the database based on greater than 80% identity to the predicted translated sequences of the query nucleotide sequences. Shown are the homologous polypeptides and the polynucleotides encoding same.

Example 2

Generating the Putative ABST Genes

Several DNA sequences of the ABST genes are synthesized by GeneArt (Hypertext Transfer Protocol://World Wide Web (dot) geneart (dot) com/). Synthetic DNA is designed in silico, based on the encoded amino-acid sequences of the ABST genes and using codon-usage Tables calculated from plant transcriptomes (example of such Tables can be found in the Codon Usage Database available online at Hypertext Transfer Protocol://World Wide Web (dot) kazusa (dot) or (dot) jp/codon/). The optimized coding sequences are designed in a way that no changes are introduced in the encoded amino acid sequence while using codons preferred for expression in dicotyledonous plants (mainly tomato and *Arabidopsis*) and monocotyledonous plants such as maize. At least one silent mutation per 20 nucleotide base pairs is introduced in the sequence compared to the original sequences to avoid possible silencing when overexpressing the gene in the target crop. To the optimized sequences the following restriction enzymes sites are added—SalI, XbaI, BamHI, SmaI at the 5' end and SacI at the 3' end. The sequences synthesized by the supplier (GeneArt, Gmbh) are cloned in the pCR-Script plasmid.

Example 3

Gene Cloning and Generation of Binary Vectors for Plant Expression

To validate their role in improving ABST and yield, selected genes were overexpressed in plants, as follows.
Cloning Strategy
Selected genes from those presented in Example 1 were cloned into binary vectors for the generation of transgenic plants. For cloning, the full-length open reading frames (ORFs) were identified. EST clusters and in some cases mRNA sequences were analyzed to identify the entire open reading frame by comparing the results of several translation algorithms to known proteins from other plant species.

In order to clone the full-length cDNAs, reverse transcription (RT) followed by polymerase chain reaction (PCR; RT-PCR) was performed on total RNA extracted from leaves, roots or other plant tissues, growing under either normal or nutrient deficient conditions. Total RNA extraction, production of cDNA and PCR amplification was performed using standard protocols described elsewhere (Sambrook J., E. F. Fritsch, and T. Maniatis. 1989. Molecular Cloning. A Laboratory Manual., 2nd Ed. Cold Spring Harbor Laboratory Press, New York.) which are well known to those skilled in the art. PCR products were purified using PCR purification kit (Qiagen)

Usually, 2 sets of primers were prepared for the amplification of each gene, via nested PCR (meaning first amplifying the gene using external primers and then using the produced PCR product as a template for a second PCR reaction, where the internal set of primers are used). Alternatively, one or two of the internal primers were used for gene amplification, both in the first and the second PCR reactions (meaning only 2-3 primers were designed for a gene). To facilitate further cloning of the cDNAs, an 8-12 bp extension is added to the 5' of each internal primer. The primer extension includes an endonuclease restriction site. The restriction sites are selected using two parameters: (a) the restriction site does not exist in the cDNA sequence; and (b) the restriction sites in the forward and reverse primers are designed such that the digested cDNA is inserted in the sense direction into the binary vector utilized for transformation. In Table 3 below, primers used for cloning ABST genes are provided.

TABLE 3

Cloned ABST genes from cDNA libraries or genomic DNA and the primers used for the cloning

| Gene Id | Polynucleotide SEQ ID NO. of the cloned gene | Polypeptide SEQ ID NO. of the encoded polypeptide | Restriction Enzymes used for cloning | Primers used for amplification (SEQ ID NO:) |
|---|---|---|---|---|
| MAB1 | 1530 | 201 | EcoRV | MAB1_EF_EcoRV AAGATATCAGACCAGAGGAGA AGACTCGATC (SEQ ID NO: 1567) MAB1_NF_EcoRV AAGATATCAGACTCCGTTCGGA GAAAAGG (SEQ ID NO: 1568) MAB1_ER_EcoRV ATGATATCTGAAGAACATCGCC TTGTCATC (SEQ ID NO: 1569) MAB1_NR_EcoRV AAGATATCACCTTGTCATCGGA TCATCTCC (SEQ ID NO: 1570) |
| MAB1_GA (optimized for expression in Maize and G.Max) | 1531 | | | Synthetic product (from pGA14_MAB1_GA) |
| MAB14 | 1538 | 219 | EcoRV | MAB14_EF_EcoRV ATGATATCCAACGAATGAAGA CTAGTAGCTG (SEQ ID NO: 1571) MAB14_NF_EcoRV ATGATATCCCAGATGGAATCCT GCCCT (SEQ ID NO: 1572) |

TABLE 3-continued

Cloned ABST genes from cDNA libraries or genomic DNA and the primers used for the cloning

| Gene Id | Polynucleotide SEQ ID NO. of the cloned gene | Polypeptide SEQ ID NO. of the encoded polypeptide | Restriction Enzymes used for cloning | Primers used for amplification (SEQ ID NO:) |
|---|---|---|---|---|
| | | | | MAB14_ER_EcoRV ATGATATCGTGTCAATGAAGG GAACGTGC (SEQ ID NO: 1573) MAB14_NR_EcoRV ATGATATCGCAAATGGATTCAG ATATTCTG (SEQ ID NO: 1574) |
| MAB14_GA (optimized for expression in Maize) | 1539 | | | Synthetic product (from pGA14_MAB14_GA) |
| MAB10 | 1532 | 212 | SalI, XbaI | MAB 10 F Sal- GCAGTCGACAACTCACAGTTCC AAACACACA (SEQ ID NO: 1575) MAB 10 Ext R Xba- GGTCTAGAATGTAAATGTCTTC GTATTAGGC (SEQ ID NO: 1576) MAB 10 NR Xba- CCTCTAGAATCACCCGAAATAA CTAGTGTC (SEQ ID NO: 1577) |
| MAB10_GA (optimized for expression in Maize) | 1533 | | | Synthetic product (from pGA18_MAB10_GA) |
| MAB25 | 1549 | 237 | PstI, SmaI | MAB25_EF_PstI- AACTGCAGCCATCGTCGTAATC CTTCTAGC (SEQ ID NO: 1578) MAB25_NF_PstI- AACTGCAGTAATCATGGGGAG GAAATCTC (SEQ ID NO: 1579) MAB25_ER_SmaI- GGGTGACAATTCCGAGTCTCAG C (SEQ ID NO: 1580) MAB25_NR_SmaI - TCCCGGGCAATTGGTCAATGGC ACTC (SEQ ID NO: 1581) |
| MAB25_GA (optimized for expression in Maize) | 1550 | | | Synthetic product (from pGA14_MAB25_GA) |
| MAB134 | 1665 | 311 | SalI, XbaI | MAB134_EF_SalI- AATGTCGACTCTCGTCTTGCTC CCAGAG (SEQ ID NO: 1582) MAB134_NF_SalI- AATGTCGACCGACACCCTTCTC CTCCTC (SEQ ID NO: 1583) MAB134_ER_XbaI- TTTCTAGAATCATATTCCAACA TCCACTTC (SEQ ID NO: 1584) MAB134_NR_XbaI- TTTCTAGACTGCTATGTTCCAC TGACTACAC (SEQ ID NO: 1585) |
| MAB99 | 1566 | 283 | SalI, SacI | MAB99_NF_SalI- AAAGTCGACCAGTTAATTCTCC GTTGTCTACTC (SEQ ID NO: 1586) MAB99_NR_SacI- TGAGCTCCTGCTTGAAACTTGC TGCTAG (SEQ ID NO: 1587) |
| MAB36 | 1554 | 254 | SalI, XbaI | MAB 36 F Sal- GGAGTCGACACAGAAATGGGT GGTTTGAAG (SEQ ID NO: 1588) |

TABLE 3-continued

Cloned ABST genes from cDNA libraries or genomic DNA and the primers used for the cloning

| Gene Id | Polynucleotide SEQ ID NO. of the cloned gene | Polypeptide SEQ ID NO. of the encoded polypeptide | Restriction Enzymes used for cloning | Primers used for amplification (SEQ ID NO:) |
|---|---|---|---|---|
| | | | | MAB 36 Ext R Xba-CCTCTAGAAATGATCACTCACT GCAACTTAG (SEQ ID NO: 1589) MAB 36 NR Xba-CCTCTAGACACTCACTGCAACT TAGAAACATC (SEQ ID NO: 1590) |
| MAB7 | 1563 | 208 | SalI, XbaI | MAB 7 Ex F Sal-AACGTCGACGCTCATTTCTCTT CTTCTTTGG (SEQ ID NO: 1591) MAB 7 NF Sal-GACGTCGACTCTTCTTTGGTTC TTACATTTCTC (SEQ ID NO: 1592) MAB 7 Ex R Xba-TCTCTAGAGCAAGACGTTATAA ACCATGC (SEQ ID NO: 1593) MAB 7 NR Xba-TCTCTAGAAGAAGACACGCTG GACAATG (SEQ ID NO: 1594) |
| MAB44 | 1557 | 267 | SalI, SacI | MAB 44 NF sal AAGGTCGACCATAAAGAACAG TGACAGGCG (SEQ ID NO: 1595) MAB 44 NR Sc AGAGCTCCACGTAGTACATTTT CACAGCAC (SEQ ID NO: 1596) |
| MAB44_GA (optimized for expression in Maize) | 1558 | | | Synthetic product (from pCR4Blunt-TOPO_MAB44_GA) |
| MAB6 | 1561 | 207 | SalI, XbaI | MAB 6 - Ex F Sal-ACCGTCGACCCTTCTCCAATTT CGTAAGC (SEQ ID NO: 1597) MAB 6 NF Sal-ACCGTCGACTTCGTAAGCTCAA AGATTTCG (SEQ ID NO: 1598) MAB 6 - Ext R XbaI-CCTCTAGAACGACTTTTAATCC CTCCAAC (SEQ ID NO: 1599) MAB 6 - NR XbaI-CCTCTAGACTCCAACAGCCACT ACAACC (SEQ ID NO: 1600) |
| MAB6_GA (optimized for expression in Maize) | 1562 | | | Synthetic product (from pGA15_MAB6_GA) |
| MAB9 | 1564 | 211 | EcoRV | MAB9_F_EcoRV AAGATATCGGTTGCTGAGGAA TCGAAGTAG (SEQ ID NO: 1601) MAB9_ER_EcoRV TTGATATCGAGCCAAGTCACAA GGAGTTTAC (SEQ ID NO: 1602) MAB9_NR_EcoRV TTGATATCCTCCGAGTGTCGCA GTAAGC (SEQ ID NO: 1603) |
| MAB9_GA (optimized for expression in Maize and G.Max) | 1565 | | | Synthetic product (from pGA15_MAB9_GA) |

TABLE 3-continued

Cloned ABST genes from cDNA libraries or genomic DNA and the primers used for the cloning

| Gene Id | Polynucleotide SEQ ID NO. of the cloned gene | Polypeptide SEQ ID NO. of the encoded polypeptide | Restriction Enzymes used for cloning | Primers used for amplification (SEQ ID NO:) |
|---|---|---|---|---|
| MAB100 | 1534 | 284 | SalI, XbaI | MAB100_EF_SalI-AATGTCGACCCAAGTTAAACTTCATATCATACAC (SEQ ID NO: 1604) MAB100_NF_SalI-AATGTCGACGAAGAGTTATTATGGCGAGCT (SEQ ID NO: 1605) MAB100_ER_XbaI-AATGTCGACCCAAGTTAAACTTCATATCATACAC (SEQ ID NO: 1606) MAB100_NR_XbaI-AATCTAGACAAACCCAACTTATTACATTACG (SEQ ID NO: 1607) |
| MAB13 | 1536 | 217 | SacI, SalI | MAB13_F_SalI_new AATGTCGACCTCGAAAATGGCCACCATTAG (SEQ ID NO: 1608) MAB 13 ExR CGAGCTCCAAAAATGCAAGAATCAAGAG (SEQ ID NO: 1609) MAB 13 F Sal AAGGTCGACTTCTCTCCAAAATGGCCAC (SEQ ID NO: 1610) MAB 13 NR Sc TGAGCTCTGCAAGAATCAAGAGAAATTTG (SEQ ID NO: 1611) |
| MAB32 | 1552 | 247 | EcoRV | MAB32_F_EcoRV-AAGATATCCTCCACTTGTTGTTCAATTCCC (SEQ ID NO: 1612) MAB32_ER_EcoRV-ATGATATCGATCTGAACAGCAGTAAGTAAGCC (SEQ ID NO: 1613) MAB32_NR_EcoRV-ATGATATCTAAGAAGAACAAGACATGGATCG (SEQ ID NO: 1614) |
| MAB35 | 1553 | 252 | SmaI | MAB35_F-CGTGAGAACTAAGAAACACCC (SEQ ID NO: 1615) MAB35_ER_SmaI-TCCCGGGACATCTTTTCAACTAAACCAAGAC (SEQ ID NO: 1616) MAB35_NR_SmaI-TCCCGGGCTAAACCAAGACTTACACAAGACG (SEQ ID NO: 1617) |
| MAB146 | 1666 | 334 | SalI, XbaI | MAB146_F_Sal-ATTGTCGACAGAGTTATGGGAGATAATAGAGGA (SEQ ID NO: 1618) MAB146_ER_Xba-ATTCTAGACTCATTCTGAGCTTTACATGTTC (SEQ ID NO: 1619) MAB146_NR_Xba-TTTCTAGATTGGTTTACACCTCAACTCACTAC (SEQ ID NO: 1620) |
| MAB2 | 1547 | Non coding | SalI, XbaI | MAB2_F_SalI AATGTCGACAACAAATGATCCTTCAGGCAGTTAAAG (SEQ ID NO: 1621) MAB2_R_Xba TTTCTAGATATTAAAACTTAGATTCGGGATCAG (SEQ ID NO: 1622) |

TABLE 3-continued

Cloned ABST genes from cDNA libraries or genomic DNA and the primers used for the cloning

| Gene Id | Polynucleotide SEQ ID NO. of the cloned gene | Polypeptide SEQ ID NO. of the encoded polypeptide | Restriction Enzymes used for cloning | Primers used for amplification (SEQ ID NO:) |
|---|---|---|---|---|
| MAB20 | 1548 | 229 | PstI, SmaI | MAB20_EF_PstI-AACTGCAGGATCATCACTTCTCAGATTTCG (SEQ ID NO: 1623) MAB20_NF_PstI-AACTGCAGAAAAATGAATTCAGAATCGCTAG (SEQ ID NO: 1624) MAB20_ER_SmaI-AACTGCAGGATCATCACTTCTCAGATTTCG (SEQ ID NO: 1625) MAB20_NR_SmaI-TCCCGGGCAATCTGACCTCAAAACTCCC (SEQ ID NO: 1626) |
| MAB43 | 1556 | 265 | PstI, SmaI | MAB43_NF_PstI AACTGCAGGATCAATGAAGATTCGGAACAG (SEQ ID NO: 1627) MAB43_ER_SmaI TCCCGGGTACAACAAGAAACCTCTGATTC (SEQ ID NO: 1628) MAB43_NR_SmaI TCCCGGGCCTGTGCCACAGCTATACTTAC (SEQ ID NO: 1629) |
| MAB46 | 1559 | 271 | SalI, SacI | MAB 46 ExF Sal-GAAGTCGACATCCGTAGTTTCAGTTTCGTCC (SEQ ID NO: 1630) MAB 46 NF Sal-GAAGTCGACCTTGTCTGTTCCAGATGAAATTG (SEQ ID NO: 1631) MAB46 ExR Sc-TGAGCTCCTCTATCGACGTCCGGATTC (SEQ ID NO: 1632) MAB 46 NR Sc-TGAGCTCCGTCCGGATTCATAAACAAC (SEQ ID NO: 1633) |
| MAB50 | 1560 | 277 | SmaI | MAB 50 ExF Sal GGAGTCGACCATCGGGACACATCTTTAGG (SEQ ID NO: 1634) MAB50_NF CATCTTTAGGCTCAAGGATTC (SEQ ID NO: 1635) MAB50_ExR_Sac TGAGCTCGATCCTCGTTTATTACAAGTCTG (SEQ ID NO: 1636) MAB50_NR_Sma TCCCGGGCACACCAAGATTGATTACAAAGAG (SEQ ID NO: 1637) |
| MAB66 | 1654 | 1655 | SalI, XbaI | MAB66_F_Sal-AATGTCGACGATTGGAGATAGGCAGGCA (SEQ ID NO: 1638) MAB66_ER_Xba-TTTCTAGAGGTAGCCAAAGCTGACACTC (SEQ ID NO: 1639) MAB66_NR_Xba-AATCTAGAGAGGCATATGCACTTCTTATCG (SEQ ID NO: 1640) |
| MAB4 | 1555 | 205 | EcoRV | MAB4_EF_EcoRV-AAGATATCCAGGACGGGTCTCGATCAG (SEQ ID NO: 1641) MAB4_NF_EcoRV-AAGATATCCAGCGAACACGTCTACGATG (SEQ ID NO: 1642) MAB4_ER_EcoRV-ATGATATCGCACGAGTTCAACTCAGCTG (SEQ ID NO: 1643) MAB4_NR_EcoRV-ATGATATCGAACTGCTTGAGATGTAACAGCT (SEQ ID NO: 1644) |

TABLE 3-continued

Cloned ABST genes from cDNA libraries or genomic DNA and the primers used for the cloning

| Gene Id | Polynucleotide SEQ ID NO. of the cloned gene | Polypeptide SEQ ID NO. of the encoded polypeptide | Restriction Enzymes used for cloning | Primers used for amplification (SEQ ID NO:) |
|---|---|---|---|---|
| MAB15_GA (optimized for expression in *Arabidopsis* and maize) | 1541 | 221 | XbaI, SacI | Synthetic product (from pGA4_MAB15) |
| MAB15a_GA (optimized for expression in Maize) | 1667 | | | Synthetic product (from pGA18_MAB15a_GA) |
| MAB15_GA_original (original sequence, not optimize) | 1540 | | | Synthetic product (from pGA14_MAB15_(EVO220)-original) |
| MAB17_GA (optimized for expression in *Arabidopsis* and maize) | 1542 | 224 | XbaI, SacI | Synthetic product (from pGA4_MAB17) |
| MAB17a_GA (optimized for expression in Maize) | 1544 | | | Synthetic product (from pCR4Blunt-TOPO_MAB17a_GA) |
| MAB17_GA_original (original sequence, not optimize) | 1543 | | | Synthetic product (pGA14_MAB17_(EVO222)-original) |
| MAB137_GA (optimized for expression in Maize, *Arabidopsis* and tomato) | 1537 | 317 | XbaI, SacI | Synthetic product (from pGA15_MAB137) |
| MAB3_GA (optimized for expression in Maize, *Arabidopsis* and tomato) | 1551 | 203 | XbaI, SacI | Synthetic product (from pCR4Blunt-Topo_MAB3) |
| MAB3_GA_original (original sequence, not optimize) | 1668 | | | Synthetic product (from pGA14_MAB3_(EVO235)-original) |
| MAB18_GA (optimized for expression in *Arabidopsis* and maize) | 1545 | 225 | XbaI, SacI | Synthetic product (from pGA4_MAB18) |
| Control Gene: GUI | 1664 | | | |

Table 3. Presented are the cloned ABST genes and control gene(s) by the Gene Id number and the polynucleotide SEQ ID NO. Also presented are the primers and the restriction enzymes used to clone the ABST genes.

PCR products were digested with the restriction endonucleases (Roche, Switzerland) according to the sites design in the primers (Table 3). Each digested PCR product was inserted into a high copy vector originated from pBlue-script KS plasmid vector (pBlue-script KS plasmid vector, Hypertext Transfer Protocol://World Wide Web (dot) stratagene (dot) com/manuals/212205 (dot) pdf). In case of the high copy vector originated from pBlue-script KS plasmid vector (pGN) PCR product was inserted in the high copy plasmid upstream to the NOS terminator (SEQ ID NO:1651) originated from pBI 101.3 binary vector (GenBank Accession No. U12640, nucleotides 4417 to 4693), Table 4 below. In other cases (pKSJ_6669a) the At6669 promoter (SEQ ID NO: 1652) is already cloned into the pBlue-script KS, so the gene is introduced downstream of the promoter (Table 4 below).

Sequencing of the inserted genes was performed, using the ABI 377 sequencer (Applied Biosystems). In some cases, after confirming the sequences of the cloned genes, the cloned cDNA accompanied with the NOS terminator was introduced into the binary vectors pGI containing the At6669 promoter via digestion with appropriate restriction endonucleases. In other cases the cloned cDNA accompanied with the At6669 promoter was introduced into the pGI vector (that hasn't already contained the At6669 promoter). In any case the insert was followed by single copy of the NOS terminator (SEQ ID NO:1651). The digested products and the linearized plasmid vector were ligated using T4 DNA ligase enzyme (Roche, Switzerland).

TABLE 4

Genes cloned from cDNA libraries or genomic DNA in a High copy plasmid

| Gene Name | High copy Plasmid | Amplified from |
| --- | --- | --- |
| MAB1 | pKSJ_6669 | RNA |
| MAB1 | | Gene Art |
| MAB10 | | Gene Art |
| MAB10 | pGN | RNA |
| MAB14 | pKSJ_6669 | RNA |
| MAB14 | | Gene Art |
| MAB15 | pGN | Gene Art (3 plasmids) |
| MAB17 | pGN | Gene Art (3 plasmids) |
| MAB 137 | pGN | Gene Art |
| MAB25 | pKSJ_6669 | RNA |
| MAB25 | | Gene Art |
| MAB3 | | Gene Art (2 plasmids) |
| MAB44 | pGN | RNA |
| MAB44 | | Gene Art |
| MAB6 | pGN | RNA |
| MAB6 | | Gene Art |
| MAB9 | pKSJ_6669 | RNA |
| MAB9 | | Gene Art |
| MAB100 | pGN | RNA |
| MAB13 | pGN | RNA |
| MAB134 | pGN | RNA |
| MAB18 | pGN | Gene Art |
| MAB2 | pGN | RNA |
| MAB20 | pKSJ_6669 | RNA |
| MAB146 | pGN | RNA |
| MAB32 | pKSJ_6669 | RNA |
| MAB35 | pKSJ_6669 | RNA |
| MAB36 | pGN | RNA |
| MAB43 | pKSJ_6669 | RNA |
| MAB46 | pGN | RNA |
| MAB50 | pKSJ_6669 | RNA |
| MAB7 | pGN | RNA |
| MAB99 | pGN | RNA |
| MAB66 | pGN | RNA |
| MAB4 | pKSJ_6669 | RNA |

Table 4

The pPI plasmid vector was constructed by inserting a synthetic poly-(A) signal sequence, originating from pGL3 basic plasmid vector (Promega, GenBank Accession No. U47295; nucleotides 4658-4811) into the HindIII restriction site of the binary vector pBI101.3 (Clontech, GenBank Accession No. U12640). pGI (FIG. 1) is similar to pPI, but the original gene in the back bone is GUS-Intron, rather than GUS.

At6669, the *Arabidopsis thaliana* promoter sequence (set forth in SEQ ID NO: 1652) is inserted in the pPI binary vector, upstream to the cloned genes by using the restriction enzymes HindIII and SalI or BamHI (Roche), following by DNA ligation and binary plasmid extraction from positive *E. coli* colonies, as described above.

Positive colonies were identified by PCR using primers which were designed to span the introduced promoter (At6669) and the cloned gene in the binary vector. In all cases the forward PCR primer was the primer set forth in SEQ ID NO:1650 (from the At6669 promoter) and the reverse primer (derived from the specific cloned gene) was as follows: For MAB1, the reverse primer was SEQ ID NO:1570; for MAB14, the reverse primer was SEQ ID NO:1574; for MAB10, the reverse primer was SEQ ID NO:1577; for MAB25, the reverse primer was SEQ ID NO:1581; for MAB134, the reverse primer was SEQ ID NO:1585; for MAB99, the reverse primer was SEQ ID NO:1587; for MAB36, the reverse primer was SEQ ID NO:1590; for MAB7, the reverse primer was SEQ ID NO:1594; for MAB44, the reverse primer was SEQ ID NO:1596; for MAB4, the reverse primer was SEQ ID NO:1600; for MAB9, the reverse primer was SEQ ID NO:1603 (MAB9); for MAB100, the reverse primer was SEQ ID NO:1606; for MAB13, the reverse primer was SEQ ID NO:1611; for MAB32, the reverse primer was SEQ ID NO:1614; for MAB35, the reverse primer was SEQ ID NO:1617; for MAB146, the reverse primer was SEQ ID NO:1620; for MAB2, the reverse primer was SEQ ID NO:1622; for MAB20, the reverse primer was SEQ ID NO:1626; for MAB43, the reverse primer was SEQ ID NO:1629; for MAB46, the reverse primer was SEQ ID NO:1633; for MAB50, the reverse primer was SEQ ID NO:1637; for MAB66, the reverse primer was SEQ ID NO:1640; for MAB4, the reverse primer was SEQ ID NO:1644; for MAB15 synthetic gene, the reverse primer was SEQ ID NO:1645; for MAB17 synthetic gene, the reverse primer was SEQ ID NO:1646; for MAB18 synthetic gene, the reverse primer was SEQ ID NO:1647; for MAB137 synthetic gene, the reverse primer was SEQ ID NO: 1648; and for MAB3 synthetic gene, the reverse primer was SEQ ID NO:1649, which are designed to span the introduced promoter and gene, in the binary vector.

Synthetic sequences [such as of MAB14, nucleotide SEQ ID NO:23, which encodes protein SEQ ID NO:219) of some of the cloned polynucleotides were ordered from a commercial supplier (GeneArt, GmbH). To optimize the coding sequence, codon-usage Tables calculated from plant transcriptomes were used [example of such Tables can be found in the Codon Usage Database available online at Hypertext Transfer Protocol://World Wide Web (dot) kazusa (dot) or (dot) jp/codon/]. The optimized coding sequences were designed in a way that no changes were introduced in the encoded amino acid sequence while using codons preferred for expression in dicotyledonous plants mainly tomato and *Arabidopsis*; and monocotyledonous plants such as maize. Such optimized sequences promote better translation rate and therefore higher protein expression levels. Parts of the sequences were ordered as the original sequences. To the optimized/non-optimized sequences flanking additional unique restriction enzymes sites were added to facilitate cloning genes in binary vectors.

Promoters used: *Arabidopsis* At6669 promoter (SEQ ID NO:1652; which is SEQ ID NO:61 of WO04081173 to Evogene Ltd.).

The sequences of the cloned cDNAs are provided in SEQ ID NOs: 1530-1534, 1536-1545, 1547-1566, 1654, 1665, 1666, 1667 and 1668. The protein translation of the amplified cDNA sequence matched exactly that of the initial bioinformatics prediction of the protein sequences. The predicted polypeptide sequences of the cloned polynucleotides are provided in SEQ ID NOs:201, 212, 284, 213, 217, 317, 219, 221, 224, 225, 226, 227, 229, 237, 203, 247, 252, 205, 265, 267, 271, 277, 207, 208, 211, 283, 1655, 311, 334, and 254.

Example 4

Transforming *Agrobacterium tumefaciens* Cells with Binary Vectors Harboring Putative ABST Genes Each of the binary vectors described in Example 3 above are used to transform *Agrobacterium* cells. Two additional binary constructs, having a GUS/Luciferase reporter gene replacing the ABST gene (positioned downstream of the At6669 promoter), are used as negative controls.

The binary vectors are introduced to *Agrobacterium tumefaciens* GV301, or LB4404 competent cells (about $10^9$ cells/mL) by electroporation. The electroporation is performed using a MicroPulser electroporator (Biorad), 0.2 cm cuvettes (Biorad) and EC-2 electroporation program (Biorad). The treated cells are cultured in LB liquid medium at 28° C. for 3 hours, then plated over LB agar supplemented with gentamycin (50 mg/L; for *Agrobacterium* strains GV301) or streptomycin (300 mg/L; for *Agrobacterium* strain LB4404) and kanamycin (50 mg/L) at 28° C. for 48 hours. *Agrobacterium* colonies which developed on the selective media were analyzed by PCR using the primers described above (Example 3) with respect to identification of positive binary vector colonies. The resulting PCR products are isolated and sequenced as described in Example 3 above, to verify that the correct ABST sequences are properly introduced to the *Agrobacterium* cells.

Example 5

Transformation of *Arabidopsis thaliana* Plants with Putative ABST Genes

*Arabidopsis thaliana* Columbia plants ($T_0$ plants) are transformed using the Floral Dip procedure described by Clough and Bent (10) and by Desfeux et al. (11), with minor modifications. Briefly, $T_0$ Plants are sown in 250 ml pots filled with wet peat-based growth mix. The pots are covered with aluminum foil and a plastic dome, kept at 4° C. for 3-4 days, then uncovered and incubated in a growth chamber at 18-24° C. under 16/8 hour light/dark cycles. The $T_0$ plants are ready for transformation six days before anthesis.

Single colonies of *Agrobacterium* carrying the binary constructs, are generated as described in Example 4 above. Colonies are cultured in LB medium supplemented with kanamycin (50 mg/L) and gentamycin (50 mg/L). The cultures are incubated at 28° C. for 48 hours under vigorous shaking and then centrifuged at 4000 rpm for 5 minutes. The pellets comprising the *Agrobacterium* cells are re-suspended in a transformation medium containing half-strength (2.15 g/L) Murashige-Skoog (Duchefa); 0.044 μM benzylamino purine (Sigma); 112 μg/L B5 Gambourg vitamins (Sigma); 5% sucrose; and 0.2 ml/L Silwet L-77 (OSI Specialists, CT) in double-distilled water, at pH of 5.7.

Transformation of $T_0$ plants is performed by inverting each plant into an *Agrobacterium* suspension, such that the above ground plant tissue is submerged for 3-5 seconds. Each inoculated $T_0$ plant is immediately placed in a plastic tray, then covered with clear plastic dome to maintain humidity and is kept in the dark at room temperature for 18 hours, to facilitate infection and transformation. Transformed (transgenic) plants are then uncovered and transferred to a greenhouse for recovery and maturation. The transgenic $T_0$ plants are grown in the greenhouse for 3-5 weeks until siliques are brown and dry. Seeds are harvested from plants and kept at room temperature until sowing.

For generating $T_1$ and $T_2$ transgenic plants harboring the genes, seeds collected from transgenic $T_0$ plants are surface-sterilized by soaking in 70% ethanol for 1 minute, followed by soaking in 5% sodium hypochloride and 0.05% triton for 5 minutes. The surface-sterilized seeds are thoroughly washed in sterile distilled water then placed on culture plates containing half-strength Murashige-Skoog (Duchefa); 2% sucrose; 0.8% plant agar; 50 mM kanamycin; and 200 mM carbenicylin (Duchefa). The culture plates are incubated at 4° C. for 48 hours then transferred to a growth room at 25° C. for an additional week of incubation. Vital $T_1$ *Arabidopsis* plants are transferred to a fresh culture plates for another week of incubation. Following incubation the $T_1$ plants are removed from culture plates and planted in growth mix contained in 250 ml pots. The transgenic plants are allowed to grow in a greenhouse to maturity. Seeds harvested from $T_1$ plants are cultured and grown to maturity as $T_2$ plants under the same conditions as used for culturing and growing the $T_1$ plants.

Example 6

Improved ABST in Tissue Culture Assay

Assay 1: Plant Growth Under Osmotic Stress (PEG) in Tissue Culture Conditions—

Osmotic stress (PEG)—conditions resembling the high osmolarity found during drought (e.g., 25% PEG8000). One of the consequences of drought is the induction of osmotic stress in the area surrounding the roots; therefore, in many scientific studies, PEG serves to simulate drought.

Surface sterilized seeds are sown in basal media [50% Murashige-Skoog medium (MS) supplemented with 0.8% plant agar as solidifying agent] in the presence of Kanamycin (for selecting only transgenic plants). After sowing, plates are transferred for 2-3 days at 4° C. for stratification and then grown at 25° C. under 12-hour light 12-hour dark daily cycles for 7 to 10 days. At this time point, seedlings randomly chosen are carefully transferred to plates hold 25% PEG in 0.5 MS media or normal conditions (0.5 MS media). Each plate contains 5 seedlings of same event, and 3-4 different plates (replicates) for each event. For each polynucleotide of the invention at least four independent transformation events are analyzed from each construct. Plants expressing the polynucleotides of the invention are compared to the average measurement of the control plants Mock-transgenic plants expressing the uidA reporter gene (GUS Intron—GUI) under the same promoter were used as control.

Digital Imaging—

A laboratory image acquisition system, which consists of a digital reflex camera (Canon EOS 300D) attached with a 55 mm focal length lens (Canon EF-S series), mounted on a reproduction device (Kaiser RS), which included 4 light units (4×150 Watts light bulb) and located in a darkroom, was used for capturing images of plantlets sawn in square agar plates.

The image capturing process was repeated every 7 days starting at day 0 till day 14. The same camera attached with a 24 mm focal length lens (Canon EF series), placed in a custom made iron mount was used for capturing images.

An image analysis system was used, which consists of a personal desktop computer (Intel P4 3.0 GHz processor) and a public domain program—ImageJ 1.37 (Java based image processing program which was developed at the U.S National Institutes of Health and freely available on the internet at Hypertext Transfer Protocol://rsbweb (dot) nih (dot) gov/). Images were captured in resolution of 6 Mega Pixels (3072× 2048 pixels) and stored in a low compression JPEG (Joint Photographic Experts Group standard) format. Next, analyzed data was saved to text files and processed using the JMP statistical analysis software (SAS institute).

Seedling Analysis—

Using the digital analysis seedling data was calculated, including leaf area, root coverage and root length.

The Relative Growth Rate (RGR) was calculated according to the following formula I.

Relative growth area rate=(Δ Area/Δ$t$)*(1/Area $t0$)  Formula I:

Δt is the current analyzed image day subtracted from the initial day (t–t0). Thus, the relative growth area rate is in units of 1/day and length growth rate is in units of 1/day.

At the end of the experiment, plantlets were removed from the media and weighed for the determination of plant fresh weight. Relative Growth Rate is determined by comparing the leaf area, root length and root coverage between each couple of sequential photographs, and results are used to resolve the effect of the gene introduced on plant vigor, under osmotic stress, as well as under optimal conditions. Similarly, the effect of the gene introduced on biomass accumulation, under osmotic stress as well as under optimal conditions, is determined by comparing the plants' fresh weight to control plants (GUI).

Statistical Analyses—

To identify outperforming genes and constructs, results from the independent transformation events are evaluate for the overall influence of the gene (gene effect) and for each of the tested events (best event). Student's t test were applied, using significance of $p<0.05$ or $p<0.1$. The JMP statistics software package is used (Version 5.2.1, SAS Institute Inc., Cary, N.C., USA).

Experimental Results

The polynucleotide sequences of the invention were assayed for a number of desired traits.

Tables 5-6 depict analyses of Leaf Area in plants overexpressing the polynucleotides of the invention under the regulation of 6669 promoter under 25% PEG conditions. Each Table represents an independent experiment, using 4 independent events per gene. Genes not connected by same letter as the control (A, B,) are significantly different from the control, with A indicating a difference at a $P<0.05$ level of significance and, A* a difference at a $P<0.1$ level of significance.

TABLE 5

Genes showing improve Leaf Area under 25% PEG

Leaf Area [$cm^2$], 25% PEG

| | Day 7 from planting | | | | | Day 14 from planting | | | | |
|---|---|---|---|---|---|---|---|---|---|---|
| Gene Id | LSM | Significance* | LSM best Event | Significance* | % improvement of Best event | LSM | Significance* | LSM best Event | Significance* | % improvement of Best event |
| GUI | 0.38 | B | 0.38 | B | | 0.68 | B | 0.68 | B | |
| MAB1 | 0.49 | A | 0.63 | A | 67 | 0.72 | B | 6 | 0.80 | 18 |
| MAB25 | 0.33 | C | 0.49 | A | 28 | 0.61 | B | 0.88 | A | 30 |

Table 5:
LSM = Least square mean;
% improvement = compare to control (GUI);
A meaning significant difference at P < 0.05,
A* meaning significant difference at P < 0.1.
The SEQ ID NOs. of the cloned genes (according to the Gene Id) which are exogenously expressed in the plants are provided in Table 3 above.

TABLE 6

Genes showing improve Leaf Area under 25% PEG

Leaf Area [$cm^2$], 25% PEG

| | Day 7 from planting | | | | | Day 14 from planting | | | | |
|---|---|---|---|---|---|---|---|---|---|---|
| Gene Id | LSM | Significance* | LSM best Event | Significance* | % improvement of Best event | LSM | Significance* | LSM best Event | Significance* | % improvement of Best event |
| GUI | 0.23 | B | 0.23 | B | | 0.44 | B | 0.44 | B | |
| MAB15 | 0.25 | B | 0.32 | A | 43 | 0.36 | B | 0.48 | B | 9 |
| MAB17 | 0.27 | A | 0.36 | A | 57 | 0.46 | B | 0.65 | A | 48 |

TABLE 6-continued

Genes showing improve Leaf Area under 25% PEG

Leaf Area [cm^2], 25% PEG

| | Day 7 from planting | | | | | Day 14 from planting | | | | |
|---|---|---|---|---|---|---|---|---|---|---|
| Gene Id | LSM | Significance* | LSM best Event | Significance* | % improvement of Best event | LSM | Significance* | LSM best Event | Significance* | % improvement of Best event |
| MAB18 | 0.30 | A | 0.36 | A | 57 | 0.39 | B | 0.51 | B | 15 |
| MAB35 | 0.21 | B | 0.26 | B | 14 | 0.38 | B | 0.60 | A | 36 |

Table 6:
LSM = Least square mean;
% improvement = compare to control (GUI);
A meaning significant difference at P < 0.05,
A* meaning significant difference at P < 0.1.
The SEQ ID NOs. of the cloned genes (according to the Gene Id) which are exogenously expressed in the plants are provided in Table 3 above.

Tables 7-9 depict analyses of Roots Coverage in plants overexpressing the polynucleotides of the invention under the regulation of 6669 promoter under 25% PEG conditions. Each Table represents an independent experiment, using 4 independent events per gene. Genes not connected by same letter as the control (A, B,) are significantly different from the control.

TABLE 7

Roots Coverage [cm^2], 25% PEG

| | Day 7 from planting | | | | | Day 14 from planting | | | | |
|---|---|---|---|---|---|---|---|---|---|---|
| Gene Id | LSM | Significance* | LSM best Event | Significance* | % improvement of Best event | LSM | Significance* | LSM best Event | Significance* | % improvement of Best event |
| GUI | 4.37 | B | 4.37 | B | | 6.69 | B | 6.69 | B | |
| MAB1 | 7.17 | A | 10.32 | A | 136 | 9.25 | A | 9.73 | A | 45 |

Table 7:
LSM = Least square mean;
% improvement = compare to control (GUI);
A meaning significant difference at P < 0.05,
A* meaning significant difference at P < 0.1.
The SEQ ID NOs. of the cloned genes (according to the Gene Id) which are exogenously expressed in the plants are provided in Table 3 above.

TABLE 8

Roots Coverage [cm^2], 25% PEG

| | Day 7 from planting | | | | | Day 14 from planting | | | | |
|---|---|---|---|---|---|---|---|---|---|---|
| Gene Id | LSM | Significance* | LSM best Event | Significance* | % improvement of Best event | LSM | Significance* | LSM best Event | Significance* | % improvement of Best event |
| GUI | 4.04 | B | 4.04 | B | | 11.09 | B | 11.09 | B | |
| MAB15 | 4.53 | B | 5.60 | A | 39 | 10.10 | B | 11.74 | B | 6 |
| MAB18 | 5.23 | A | 6.79 | A | 68 | 9.92 | B | 10.29 | B | −7 |
| MAB146 | 5.10 | B | 7.01 | A | 73 | 8.67 | B | 10.04 | B | −9 |

Table 8:
LSM = Least square mean;
% improvement = compare to control (GUI);
A meaning significant difference at P < 0.05,
A* meaning significant difference at P < 0.1.
The SEQ ID NOs. of the cloned genes (according to the Gene Id) which are exogenously expressed in the plants are provided in Table 3 above.

TABLE 9

| | Roots Coverage [cm^2], 25% PEG | | | | | | | | |
|---|---|---|---|---|---|---|---|---|---|
| | Day 7 from planting | | | | | Day 14 from planting | | | |
| Gene Id | LSM | Significance* | LSM best Event | Significance* | % improvement of Best event | LSM | Significance* | LSM best Event | Significance* | % improvement of Best event |
| GUI | 2.11 | B | 2.11 | B | | 5.67 | B | 5.67 | B | |
| MAB18 | 2.05 | B | 2.75 | B | 30 | 5.40 | B | 8.76 | A | 55 |
| MAB32 | 1.98 | B | 5.06 | A | 140 | 4.31 | B | 10.55 | A | 86 |
| MAB35 | 2.62 | B | 3.82 | A | 81 | 7.19 | A* | 10.04 | A | 77 |
| MAB4 | 3.03 | A | 5.64 | A | 168 | 7.38 | A* | 11.38 | A | 101 |
| MAB146 | 1.84 | B | 3.65 | A | 73 | 5.05 | B | 9.21 | A | 63 |

Table 9:
LSM = Least square mean;
% improvement = compare to control (GUI);
A meaning significant difference at P < 0.05,
A* meaning significant difference at P < 0.1.
The SEQ ID NOs. of the cloned genes (according to the Gene Id) which are exogenously expressed in the plants are provided in Table 3 above.

Tables 10-11 depict analyses of Roots Length in plants overexpressing the polynucleotides of the invention under the regulation of 6669 promoter in 25% PEG. Each Table represents an independent experiment, using 4 independent events per gene. Genes not connected by same letter as the control (A, B,) are significantly different from the control.

TABLE 10

| | Roots Length [cm], PEG 25% | | | | | | | | |
|---|---|---|---|---|---|---|---|---|---|
| | Day 7 from planting | | | | | Day 14 from planting | | | |
| Gene Id | LSM | Significance* | LSM best Event | Significance* | % improvement of Best event | LSM | Significance* | LSM best Event | Significance* | % improvement of Best event |
| GUI | 4.71 | A | 4.71 | A | | 5.71 | B | 5.71 | B | |
| MAB1 | 5.37 | A | 5.91 | A | 25 | 6.09 | B | 6.40 | B | 12 |

Table 10:
LSM = Least square mean;
% improvement = compare to control (GUI);
A meaning significant difference at P < 0.05,
A* meaning significant difference at P < 0.1.
The SEQ ID NOs. of the cloned genes (according to the Gene Id) which are exogenously expressed in the plants are provided in Table 3 above.

TABLE 11

| | Roots Length [cm], PEG 25% | | | | | | | | |
|---|---|---|---|---|---|---|---|---|---|
| | Day 7 from planting | | | | | Day 14 from planting | | | |
| Gene Id | LSM | Significance* | LSM best Event | Significance* | % improvement of Best event | LSM | Significance* | LSM best Event | Significance* | % improvement of Best event |
| GUI | 2.88 | B | 2.88 | B | | 5.11 | B | 5.11 | B | |
| MAB18 | 3.22 | B | 4.29 | A | 49 | 4.86 | B | 6.33 | B | 24 |
| MAB32 | 2.74 | B | 5.78 | A | 101 | 3.75 | B | 7.17 | A | 40 |
| MAB35 | 3.35 | A* | 4.79 | A | 66 | 5.30 | B | 6.76 | A | 32 |
| MAB4 | 3.25 | B | 4.80 | A | 67 | 5.24 | B | 7.32 | A | 43 |
| MAB146 | 2.43 | B | 4.00 | A | 39 | 4.04 | B | 6.39 | A | 25 |

Table 11:
LSM = Least square mean;
% improvement = compare to control (GUI);
A meaning significant difference at P < 0.05,
A* meaning significant difference at P < 0.1.
The SEQ ID NOs. of the cloned genes (according to the Gene Id) which are exogenously expressed in the plants are provided in Table 3 above.

Tables 12-13 depict analyses of Leaf Area RGR in plants overexpressing the polynucleotides of the invention under the regulation of 6669 promoter in 25% PEG. Each Table represents an independent experiment, using 4 independent events per gene. Genes not connected by same letter as the control (A, B,) are significantly different from the control.

Tables 14-18 depict analyses of Roots Coverage RGR in plants overexpressing the polynucleotides of the invention under the regulation of 6669 promoter in 25% PEG. Each Table represents an independent experiment, using 4 independent events per gene. Genes not connected by same letter as the control (A, B,) are significantly different from the control.

TABLE 12

| | Leaf Area RGR [cm^2/day], PEG 25% | | | | | | | | | |
|---|---|---|---|---|---|---|---|---|---|---|
| | Day 7 from planting | | | | | Day 14 from planting | | | | |
| Gene Id | LSM | Significance* | LSM best Event | Significance* | % improvement of Best event | LSM | Significance* | LSM best Event | Significance* | % improvement of Best event |
| GUI | 0.46 | B | 0.46 | B | | 0.12 | B | 0.12 | B | |
| MAB1 | 0.68 | A | 1.47 | A | 222 | 0.20 | A | 0.30 | A | 151 |
| MAB17 | 0.43 | B | 0.50 | B | 8 | 0.17 | B | 0.29 | A | 145 |
| MAB35 | 0.65 | A | 0.71 | A | 54 | 0.19 | A | 0.23 | A | 93 |
| MAB146 | 0.55 | B | 0.80 | A | 75 | 0.16 | B | 0.20 | B | 66 |

Table 12:
LSM = Least square mean;
% improvement = compare to control (GUI);
A meaning significant difference at P < 0.05,
A* meaning significant difference at P < 0.1.
The SEQ ID NOs. of the cloned genes (according to the Gene Id) which are exogenously expressed in the plants are provided in Table 3 above.

TABLE 13

| | Leaf Area RGR [cm^2/day], PEG 25% | | | | | | | | | |
|---|---|---|---|---|---|---|---|---|---|---|
| | Day 7 from planting | | | | | Day 10 from planting | | | | |
| Gene Id | LSM | Significance* | LSM best Event | Significance* | % improvement of Best event | LSM | Significance* | LSM best Event | Significance* | % improvement of Best event |
| GUI | 0.49 | B | 0.49 | B | | 0.24 | B | 0.24 | B | |
| MAB6 | 0.89 | A | 1.60 | A | 226 | 0.27 | B | 0.33 | B | 39 |

Table 13:
LSM = Least square mean;
% improvement = compare to control (GUI);
A meaning significant difference at P < 0.05,
A* meaning significant difference at P < 0.1.
The SEQ ID NOs. of the cloned genes (according to the Gene Id) which are exogenously expressed in the plants are provided in Table 3 above.

TABLE 14

| | Roots Coverage RGR [cm^2/day], PEG 25% | | | | | | | | | |
|---|---|---|---|---|---|---|---|---|---|---|
| | Day 7 from planting | | | | | Day 14 from planting | | | | |
| Gene Id | LSM | Significance* | LSM best Event | Significance* | % improvement of Best event | LSM | Significance* | LSM best Event | Significance* | % improvement of Best event |
| GUI | 5.74 | B | 5.74 | B | | 0.11 | B | 0.11 | B | |
| MAB25 | 4.03 | B | 5.44 | B | −5 | 0.16 | B | 0.21 | A | 96 |
| MAB44 | 5.32 | B | 7.79 | B | 36 | 0.17 | B | 0.28 | A | 155 |

Table 14:
LSM = Least square mean;
% improvement = compare to control (GUI);
A meaning significant difference at P < 0.05,
A* meaning significant difference at P < 0.1.
The SEQ ID NOs. of the cloned genes (according to the Gene Id) which are exogenously expressed in the plants are provided in Table 3 above.

TABLE 15

Roots Coverage RGR [cm^2/day], PEG 25%

| | Day 7 from planting | | | | | Day 14 from planting | | | | |
|---|---|---|---|---|---|---|---|---|---|---|
| Gene Id | LSM | Significance* | LSM best Event | Significance* | % improvement of Best event | LSM | Significance* | LSM best Event | Significance* | % improvement of Best event |
| GUI | 0.43 | B | 0.43 | B | | 0.30 | B | 0.30 | B | |
| MAB1 | 2.16 | A | 3.09 | A | 621 | 0.36 | B | 0.43 | A | 44 |
| MAB15 | 1.55 | A | 2.81 | A | 555 | 0.30 | B | 0.33 | B | 9 |
| MAB17 | 1.99 | A | 4.08 | A | 852 | 0.35 | B | 0.53 | A | 78 |
| MAB18 | 1.44 | A | 1.90 | A | 343 | 0.29 | B | 0.36 | B | 19 |
| MAB35 | 1.10 | B | 1.71 | B | 298 | 0.37 | B | 0.48 | A | 59 |
| MAB146 | 2.16 | A | 4.03 | A | 841 | 0.30 | B | 0.41 | A | 38 |

Table 15:
LSM = Least square mean;
% improvement = compare to control (GUI);
A meaning significant difference at P < 0.05,
A* meaning significant difference at P < 0.1.
The SEQ ID NOs. of the cloned genes (according to the Gene Id) which are exogenously expressed in the plants are provided in Table 3 above.

TABLE 16

Roots Coverage RGR [cm^2/day], PEG 25%

| | Day 7 from planting | | | | | Day 14 from planting | | | | |
|---|---|---|---|---|---|---|---|---|---|---|
| Gene Id | LSM | Significance* | LSM best Event | Significance* | % improvement of Best event | LSM | Significance* | LSM best Event | Significance* | % improvement of Best event |
| GUI | 1.27 | B | 1.27 | B | | 0.08 | B | 0.08 | B | |
| MAB100 | 1.26 | B | 1.52 | B | 19 | 0.12 | B | 0.19 | A | 131 |
| MAB134 | 1.64 | A* | 2.20 | A | 73 | 0.08 | B | 0.12 | B | 48 |
| MAB13 | 1.57 | B | 2.16 | A | 70 | 0.19 | A | 0.32 | A | 294 |
| MAB15 | 1.61 | A* | 2.71 | A | 113 | 0.10 | B | 0.13 | B | 56 |
| MAB17 | 2.15 | A | 2.24 | A | 76 | 0.13 | B | 0.15 | B | 88 |
| MAB3_GA | 1.52 | B | 2.02 | A | 58 | 0.09 | B | 0.12 | B | 45 |

Table 16:
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 17

Roots Coverage RGR [cm^2/day], PEG 25%

| | Day 7 from planting | | | | | Day 14 from planting | | | | |
|---|---|---|---|---|---|---|---|---|---|---|
| Gene Id | LSM | Significance* | LSM best Event | Significance* | % improvement of Best event | LSM | Significance* | LSM best Event | Significance* | % improvement of Best event |
| GUI | 0.95 | B | 0.95 | B | | 0.30 | B | 0.30 | B | |
| MAB18 | 0.75 | B | 2.04 | A | 116 | 0.29 | B | 0.47 | A | 60 |
| MAB35 | 1.44 | A* | 4.53 | A | 379 | 0.32 | B | 0.48 | A | 63 |
| MAB4 | 1.28 | B | 2.17 | A | 129 | 0.29 | B | 0.44 | A | 49 |
| MAB146 | 0.47 | B | 0.86 | B | −9 | 0.35 | B | 0.45 | A | 52 |

Table 17:
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 18

Roots Coverage RGR [cm^2/day], PEG 25%

| | Day 7 from planting | | | | | Day 10 from planting | | | | |
|---|---|---|---|---|---|---|---|---|---|---|
| Gene Id | LSM | Significance* | LSM best Event | Significance* | % improvement of Best event | LSM | Significance* | LSM best Event | Significance* | % improvement of Best event |
| GUI | 1.66 | B | 1.66 | B | | 0.21 | B | 0.21 | B | |
| MAB43 | 1.43 | B | 2.24 | B | 35 | 0.29 | A | 0.39 | A | 86 |

Table 18:
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

Tables 19-21 depict analyses of Roots Length RGR in plants overexpressing the polynucleotides of the invention under the regulation of 6669 promoter in 25% PEG. Each Table represents an independent experiment, using 4 independent events per gene. Genes not connected by same letter as the control (A, B,) are significantly different from the control.

TABLE 19

Roots Length RGR [cm/day], PEG 25%

| | Day 7 from planting | | | | | Day 14 from planting | | | | |
|---|---|---|---|---|---|---|---|---|---|---|
| Gene Id | LSM | Significance* | LSM best Event | Significance* | % improvement of Best event | LSM | Significance* | LSM best Event | Significance* | % improvement of Best event |
| GUI | 0.23 | B | 0.23 | B | | 0.09 | B | 0.09 | B | |
| MAB1 | 0.46 | A | 0.58 | A | 148 | 0.12 | A | 0.14 | A | 58 |
| MAB15 | 0.43 | A | 0.58 | A | 148 | 0.08 | B | 0.10 | B | 16 |
| MAB17 | 0.45 | A | 0.57 | A | 147 | 0.11 | A | 0.16 | A | 87 |
| MAB18 | 0.41 | A | 0.44 | A | 89 | 0.10 | B | 0.13 | A | 45 |
| MAB35 | 0.31 | B | 0.37 | A | 59 | 0.10 | B | 0.13 | A | 51 |
| MAB146 | 0.49 | A | 0.65 | A | 178 | 0.09 | B | 0.10 | B | 17 |

Table 19:
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 20

Roots Length RGR [cm/day], PEG 25%

| | Day 7 from planting | | | | | Day 14 from planting | | | | |
|---|---|---|---|---|---|---|---|---|---|---|
| Gene Id | LSM | Significance* | LSM best Event | Significance* | % improvement of Best event | LSM | Significance* | LSM best Event | Significance* | % improvement of Best event |
| GUI | 0.20 | B | 0.20 | B | | 0.07 | B | 0.07 | B | |
| MAB134 | 0.28 | A | 0.33 | A | 68 | 0.07 | B | 0.08 | B | 16 |
| MAB13 | 0.34 | A | 0.46 | A | 133 | 0.11 | A | 0.15 | A | 113 |
| MAB15 | 0.30 | A | 0.47 | A | 139 | 0.06 | B | 0.07 | B | 1 |
| MAB17 | 0.39 | A | 0.44 | A | 121 | 0.09 | B | 0.10 | B | 39 |
| MAB3_GA | 0.28 | A | 0.34 | A | 72 | 0.05 | B | 0.08 | B | 8 |

Table 20;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 21

Roots Length RGR [cm/day], PEG 25%

| | Day 7 from planting | | | | | Day 10 from planting | | | | |
|---|---|---|---|---|---|---|---|---|---|---|
| Gene Id | LSM | Significance* | LSM best Event | Significance* | % improvement of Best event | LSM | Significance* | LSM best Event | Significance* | % improvement of Best event |
| GUI | 0.29 | B | 0.29 | B | | 0.11 | B | 0.11 | B | |
| MAB137 | 0.27 | B | 0.39 | A | 32 | 0.11 | B | 0.12 | B | 11 |
| MAB43 | 0.33 | B | 0.49 | A | 66 | 0.14 | A | 0.17 | A | 60 |
| MAB50 | 0.37 | A | 0.53 | A | 82 | 0.13 | B | 0.15 | A | 45 |
| MAB6 | 0.33 | B | 0.43 | A | 47 | 0.12 | B | 0.15 | B | 38 |

Table 21;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

Tables 22-23 depict analyses of Plant Fresh Weight in plants overexpressing the polynucleotides of the invention under the regulation of 6669 promoter in 25% PEG. Each Table represents an independent experiment, using 4 independent events per gene. Genes not connected by same letter as the control (A, B,) are significantly different from the control.

TABLE 22

Plant Fresh Weight [gr], PEG 25%

| Gene Id | LSM | Significance* | LSM best Event | Significance* | % improvement of Best event |
|---|---|---|---|---|---|
| GUI | 0.20 | B | 0.20 | B | |
| MAB15 | 0.25 | B | 0.30 | A | 51 |
| MAB18 | 0.21 | B | 0.26 | A | 33 |

Table 22;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 23

Plant Fresh Weight [gr], PEG 25%

| Gene Id | LSM | Significance* | LSM best Event | Significance* | % improvement of Best event |
|---|---|---|---|---|---|
| GUI | 0.18 | B | 0.18 | B | |
| MAB17 | 0.22 | B | 0.29 | A | 66 |
| MAB3_GA | 0.18 | B | 0.27 | A | 53 |

Table 23;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

Tables 24-27 depict analyses of Leaf Area in plants overexpressing the polynucleotides of the invention under the regulation of 6669 promoter in normal conditions. Each Table represents an independent experiment, using 4 independent events per gene. Genes not connected by same letter as the control (A, B,) are significantly different from the control.

TABLE 24

Leaf Area [cm^2], Normal Conditions

| | Day 7 from planting | | | | | Day 14 from planting | | | | |
|---|---|---|---|---|---|---|---|---|---|---|
| Gene Id | LSM | Significance* | LSM best Event | Significance* | % improvement of Best event | LSM | Significance* | LSM best Event | Significance* | % improvement of Best event |
| GUI | 0.49 | B | 0.49 | B | | 0.82 | B | 0.82 | B | |
| MAB1 | 0.65 | A | 0.73 | A | 47 | 1.00 | A | 1.13 | A | 38 |

Table 24;
LSM = Least square mean;
% improvement = compare to control (GUI);
A meaning significantly different at P < 0.05.
The SEQ ID NOs. of the cloned genes (according to the Gene Id) which are exogenously expressed in the plants are provided in Table 3 above.

TABLE 25

Leaf Area [cm^2], Normal Conditions

| | Day 7 from planting | | | | | Day 14 from planting | | | | |
|---|---|---|---|---|---|---|---|---|---|---|
| Gene Id | LSM | Significance* | LSM best Event | Significance* | % improvement of Best event | LSM | Significance* | LSM best Event | Significance* | % improvement of Best event |
| GUI | 0.24 | B | 0.24 | B | | 0.56 | B | 0.56 | B | |
| MAB17 | 0.31 | A | 0.34 | A | 40 | 0.73 | A | 0.90 | A | 61 |
| MAB18 | 0.29 | A | 0.37 | A | 52 | 0.69 | A | 0.79 | A | 42 |

Table 25:
LSM = Least square mean;
% improvement = compare to control (GUI);
A meaning significant different at $P < 0.05$,
A* meaning significant different at $P < 0.1$.
The SEQ ID NOs. of the cloned genes (according to the Gene Id) which are exogenously expressed in the plants are provided in Table 3 above.

TABLE 26

Leaf Area [cm^2], Normal Conditions

| | Day 7 from planting | | | | | Day 14 from planting | | | | |
|---|---|---|---|---|---|---|---|---|---|---|
| Gene Id | LSM | Significance* | LSM best Event | Significance* | % improvement of Best event | LSM | Significance* | LSM best Event | Significance* | % improvement of Best event |
| GUI | 0.39 | B | 0.39 | B | | 0.98 | B | 0.98 | B | |
| MAB15 | 0.46 | A* | 0.61 | A | 57 | 1.22 | A | 1.38 | A | 41 |
| MAB17 | 0.46 | A* | 0.57 | A | 47 | 1.13 | A* | 1.32 | A | 34 |
| MABA3_GA | 0.38 | B | 0.56 | A | 45 | 0.97 | B | 1.38 | A | 40 |

Table 26:
LSM = Least square mean;
% improvement = compare to control (GUI); );
A meaning significant different at $P < 0.05$,
A* meaning significant different at $P < 0.1$.
The SEQ ID NOs. of the cloned genes (according to the Gene Id) which are exogenously expressed in the plants are provided in Table 3 above.

TABLE 27

Leaf Area [cm^2], Normal conditions

| | Day 7 from planting | | | | | Day 10 from planting | | | | |
|---|---|---|---|---|---|---|---|---|---|---|
| Gene Id | LSM | Significance* | LSM best Event | Significance* | % improvement of Best event | LSM | Significance* | LSM best Event | Significance* | % improvement of Best event |
| GUI | 0.34 | B | 0.34 | B | | 0.67 | B | 0.67 | B | |
| MAB6 | 0.32 | B | 0.41 | A | 19 | 0.60 | B | 0.74 | B | 0.60 |

Table 27:
LSM = Least square mean;
% improvement = compare to control (GUI);
A meaning significant different at $P < 0.05$,
A* meaning significant different at $P < 0.1$.
The SEQ ID NOs. of the cloned genes (according to the Gene Id) which are exogenously expressed in the plants are provided in Table 3 above.

Tables 28-31 depict analyses of Roots Coverage in plants overexpressing the polynucleotides of the invention under the regulation of 6669 promoter in normal conditions. Each Table represents an independent experiment, using 4 independent events per gene. Genes not connected by same letter as the control (A, B,) are significantly different from the control.

TABLE 28

Roots Coverage [cm^2], Normal conditions

| | Day 7 from planting | | | | | Day 14 from planting | | | | |
|---|---|---|---|---|---|---|---|---|---|---|
| Gene Id | LSM | Significance* | LSM best Event | Significance* | % improvement of Best event | LSM | Significance* | LSM best Event | Significance* | % improvement of Best event |
| GUI | 3.34 | B | 3.34 | B | | 11.61 | B | 11.61 | B | |
| MAB18 | 3.31 | B | 4.78 | A | 43 | 10.66 | B | 13.30 | B | 14 |

Table 28;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 29

Roots Coverage [cm^2], Normal conditions
Day 7 from planting

| Gene Id | LSM | Significance* | LSM best Event | Significance* | % improvement of Best event |
|---|---|---|---|---|---|
| GUI | 5.40 | B | 5.40 | B | |
| MAB100 | 5.05 | B | 7.06 | A | 31 |

Table 29:
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 30

Roots Coverage [cm^2], Normal conditions

| | Day 7 from planting | | | | | Day 14 from planting | | | | |
|---|---|---|---|---|---|---|---|---|---|---|
| Gene Id | LSM | Significance* | LSM best Event | Significance* | % improvement of Best event | LSM | Significance* | LSM best Event | Significance* | % improvement of Best event |
| GUI | 3.53 | B | 3.53 | B | | 8.52 | B | 8.52 | B | |
| MAB18 | 4.17 | A* | 5.30 | A | 50 | 9.81 | A* | 12.89 | A | 51 |
| MAB32 | 2.55 | B | 4.71 | A | 33 | 6.40 | B | 12.37 | A | 45 |
| MAB35 | 3.73 | B | 4.59 | A | 30 | 8.55 | B | 11.12 | A | 30 |
| MAB46 | 2.46 | B | 3.42 | B | −3 | 6.55 | B | 10.98 | A | 29 |
| MAB146 | 2.33 | B | 3.95 | B | 12 | 7.05 | B | 10.86 | A | 28 |

Table 30:
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 31

Roots Coverage [cm^2], Normal conditions

| | Day 7 from planting | | | | Day 10 from planting | | | |
|---|---|---|---|---|---|---|---|---|
| Gene Id | LSM | Significance* | LSM best Event | Significance* | % improvement of Best event | LSM | Significance* | LSM best Event | Significance* | % improvement of Best event |
| GUI | 3.73 | B | 3.73 | B | | 7.11 | B | 7.11 | B | |
| MAB6 | 3.63 | B | 4.94 | A | 33 | 6.30 | B | 8.00 | B | 13 |

Table 31:
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

Tables 32-33 depict analyses of Roots Length in plants overexpressing the polynucleotides of the invention under the regulation of 6669 promoter in normal conditions. Each Table represents an independent experiment, using 4 independent events per gene. Genes not connected by same letter as the control (A, B,) are significantly different from the control.

Tables 34-36 depict analyses of Leaf Area RGR in plants overexpressing the polynucleotides of the invention under the regulation of 6669 promoter in normal conditions. Each Table represents an independent experiment, using 4 independent events per gene. Genes not connected by same letter as the control (A, B,) are significantly different from the control.

TABLE 32

Roots Length [cm], Normal conditions

| | Day 7 from planting | | | | | Day 14 from planting | | | | |
|---|---|---|---|---|---|---|---|---|---|---|
| Gene Id | LSM | Significance* | LSM best Event | Significance* | % improvement of Best event | LSM | Significance* | LSM best Event | Significance* | % improvement of Best event |
| GUI | 5.89 | B | 5.89 | B | | 6.82 | B | 6.82 | B | |
| MAB1 | 6.73 | A | 7.39 | A | 26 | 7.02 | B | 7.63 | B | 12 |
| MAB10 | 5.45 | B | 8.07 | A | 37 | 5.83 | B | 8.18 | B | 20 |

Table 32:
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 33

Roots Length [cm], Normal conditions

| | Day 7 from planting | | | | | Day 14 from planting | | | | |
|---|---|---|---|---|---|---|---|---|---|---|
| Gene Id | LSM | Significance* | LSM best Event | Significance* | % improvement of Best event | LSM | Significance* | LSM best Event | Significance* | % improvement of Best event |
| GUI | 3.96 | B | 3.96 | B | | 6.51 | B | 6.51 | B | |
| MAB18 | 5.07 | A | 5.70 | A | 44 | 7.08 | A | 8.03 | A | 23 |
| MAB32 | 3.68 | B | 6.12 | A | 55 | 5.82 | B | 8.22 | A | 26 |
| MAB35 | 4.58 | A | 5.76 | A | 46 | 6.77 | B | 7.75 | A | 19 |
| MAB46 | 3.39 | B | 4.31 | B | 9 | 5.55 | B | 7.42 | A | 14 |
| MAB146 | 3.14 | B | 4.82 | A | 22 | 5.47 | B | 7.48 | A | 15 |

Table 33:
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 34

Leaf Area RGR [cm/day], Normal conditions

| Gene Id | Day 7 from planting | | | | | Day 14 from planting | | | | |
|---|---|---|---|---|---|---|---|---|---|---|
| | LSM | Significance* | LSM best Event | Significance* | % improvement of Best event | LSM | Significance* | LSM best Event | Significance* | % improvement of Best event |
| GUI | 0.43 | B | 0.43 | B | | 0.20 | B | 0.20 | B | |
| MAB15 | 0.79 | A | 1.25 | A | 189 | 0.21 | B | 0.27 | B | 36 |
| MAB146 | 0.62 | B | 0.97 | A | 124 | 0.15 | C | 0.18 | B | −13 |

Table 34:
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 35

Leaf Area RGR [cm/day], Normal conditions

| Gene Id | Day 7 from planting | | | | | Day 14 from planting | | | | |
|---|---|---|---|---|---|---|---|---|---|---|
| | LSM | Significance* | LSM best Event | Significance* | % improvement of Best event | LSM | Significance* | LSM best Event | Significance* | % improvement of Best event |
| GUI | 0.73 | B | 0.73 | B | | 0.21 | B | 0.21 | B | |
| MAB100 | 0.72 | B | 1.00 | A | 37 | 0.27 | B | 0.32 | A | 48 |
| MAB134 | 0.85 | B | 0.92 | B | 27 | 0.31 | A | 0.37 | A | 75 |
| MAB15 | 0.88 | A* | 1.24 | A | 70 | 0.28 | B | 0.33 | A | 56 |
| MAB17 | 0.91 | A | 1.18 | A | 62 | 0.26 | B | 0.33 | A | 55 |
| MAB3_GA | 0.88 | B | 1.16 | A | 59 | 0.27 | B | 0.31 | B | 46 |

Table 35:
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 36

Leaf Area RGR [cm/day], Normal conditions

| Gene Id | Day 7 from planting | | | | | Day 14 from planting | | | | |
|---|---|---|---|---|---|---|---|---|---|---|
| | LSM | Significance* | LSM best Event | Significance* | % improvement of Best event | LSM | Significance* | LSM best Event | Significance* | % improvement of Best event |
| GUI | 0.92 | B | | | | 0.29 | B | 0.29 | B | |
| MAB32 | 0.95 | B | 1.31 | A | 43 | 0.28 | B | 0.31 | B | 5 |

Table 36:
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

Tables 37-41 depict analyses of Roots Coverage RGR in plants overexpressing the polynucleotides of the invention under the regulation of 6669 promoter in normal conditions. Each Table represents an independent experiment, using 4 independent events per gene. Genes not connected by same letter as the control (A, B,) are significantly different from the control.

TABLE 37

Roots Coverage RGR [cm/day], Normal conditions

| | Day 7 from planting | | | | | Day 14 from planting | | | | |
|---|---|---|---|---|---|---|---|---|---|---|
| Gene Id | LSM | Significance* | LSM best Event | Significance* | % improvement of Best event | LSM | Significance* | LSM best Event | Significance* | % improvement of Best event |
| GUI | 5.62 | B | 5.62 | B | | 0.18 | B | 0.18 | B | |
| MAB10 | 7.69 | B | 15.10 | A | 168 | 0.08 | B | 0.14 | B | −20 |
| MAB44 | 5.28 | B | 11.69 | A | 108 | 0.13 | B | 0.17 | B | −5 |

Table 37:
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 38

Roots Coverage RGR [cm/day], Normal conditions

| | Day 7 from planting | | | | | Day 14 from planting | | | | |
|---|---|---|---|---|---|---|---|---|---|---|
| Gene Id | LSM | Significance* | LSM best Event | Significance* | % improvement of Best event | LSM | Significance* | LSM best Event | Significance* | % improvement of Best event |
| GUI | 0.23 | B | 0.23 | B | | 0.40 | B | 0.40 | B | |
| MAB1 | 0.90 | A | 1.23 | A | 444 | 0.33 | B | 0.42 | B | 7 |
| MAB15 | 1.06 | A | 1.65 | A | 628 | 0.34 | B | 0.42 | B | 6 |
| MAB18 | 0.94 | A | 1.76 | A | 677 | 0.37 | B | 0.52 | B | 32 |
| MAB35 | 0.56 | B | 1.00 | A | 342 | 0.38 | B | 0.41 | B | 3 |
| MAB146 | 0.80 | A | 1.09 | A | 381 | 0.35 | B | 0.50 | B | 26 |

Table 38;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 39

Roots Coverage RGR [cm/day], Normal conditions

| | Day 7 from planting | | | | | Day 14 from planting | | | | |
|---|---|---|---|---|---|---|---|---|---|---|
| Gene Id | LSM | Significance* | LSM best Event | Significance* | % improvement of Best event | LSM | Significance* | LSM best Event | Significance* | % improvement of Best event |
| GUI | 1.64 | B | 1.64 | B | | 0.12 | B | 0.12 | B | |
| MAB134 | 3.09 | A | 4.38 | A | 167 | 0.14 | B | 0.17 | B | 35 |
| MAB13 | 2.47 | A | 2.82 | A | 72 | 0.11 | B | 0.13 | B | 6 |
| MAB15 | 1.96 | B | 2.75 | A | 68 | 0.15 | B | 0.16 | B | 33 |
| MAB17 | 2.09 | B | 3.09 | A | 89 | 0.15 | B | 0.20 | A | 60 |

Table 39:
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 40

Roots Coverage RGR [cm/day], Normal conditions

| | Day 7 from planting | | | | Day 14 from planting | | | | |
|---|---|---|---|---|---|---|---|---|---|
| Gene Id | LSM | Signifi-cance* | LSM best Event | Signifi-cance* | % improve-ment of Best event | LSM | Signifi-cance* | LSM best Event | Signifi-cance* | % improve-ment of Best event |
| GUI | 2.53 | B | 2.53 | B | | 0.24 | B | 0.24 | B | |
| MAB35 | 1.66 | B | 4.14 | A | 63 | 0.29 | B | 0.54 | A | 123 |
| MAB4 | 1.46 | B | 2.64 | B | 4 | 0.32 | B | 0.42 | A | 73 |
| MAB146 | 0.62 | B | 0.95 | B | −63 | 0.41 | A | 0.75 | A | 207 |

Table 40:
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 41

Roots Coverage RGR [cm/day], Normal conditions

| | Day 7 from planting | | | | Day 10 from planting | | | | |
|---|---|---|---|---|---|---|---|---|---|
| Gene Id | LSM | Significance* | LSM best Event | Significance* | % improvement of Best event | LSM | Significance* | LSM best Event | Significance* | % improvement of Best event |
| GUI | 1.08 | B | 1.08 | B | | 0.31 | B | 0.31 | B | |
| MAB137 | 1.36 | B | 2.03 | A | 88 | 0.26 | B | 0.31 | B | 1 |
| MAB43 | 1.39 | B | 2.35 | A | 118 | 0.23 | B | 0.27 | B | −12 |
| MAB50 | 1.57 | A | 1.98 | A | 83 | 0.27 | B | 0.30 | B | −3 |
| MAB6 | 1.16 | B | 1.94 | A | 80 | 0.25 | B | 0.29 | B | −6 |
| MAB99 | 1.48 | A | 2.63 | A | 144 | 0.21 | B | 0.27 | B | −13 |

Table 41:
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

Tables 42-46 depict analyses of Roots Length RGR in plants overexpressing the polynucleotides of the invention under the regulation of 6669 promoter in normal conditions. Each Table represents an independent experiment, using 4 independent events per gene. Genes not connected by same letter as the control (A, B,) are significantly different from the control.

TABLE 42

Roots Length RGR [cm/day], Normal conditions
Day 7 from planting

| Gene Id | LSM | Signifi-cance* | LSM best Event | Signifi-cance* | % improvement of Best event |
|---|---|---|---|---|---|
| GUI | 1.07 | B | 1.07 | B | |
| MAB10 | 1.29 | B | 2.01 | A | 88 |

Table 42:
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 43

Roots Length RGR [cm/day], Normal conditions
Day 7 from planting

| Gene Id | LSM | Signifi-cance* | LSM best Event | Signifi-cance* | % improvement of Best event |
|---|---|---|---|---|---|
| GUI | 0.17 | B | 0.17 | B | |
| MAB1 | 0.26 | A | 0.34 | A | 93 |
| MAB15 | 0.32 | A | 0.45 | A | 156 |
| MAB17 | 0.24 | A | 0.28 | A | 61 |
| MAB18 | 0.30 | A | 0.41 | A | 136 |
| MAB146 | 0.26 | A | 0.34 | A | 93 |

Table 43:
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 44

| | Roots Length RGR [cm/day], Normal conditions | | | | | | | | |
|---|---|---|---|---|---|---|---|---|---|
| | Day 7 from planting | | | | | Day 14 from planting | | | |
| Gene Id | LSM | Significance* | LSM best Event | Significance* | % improvement of Best event | LSM | Significance* | LSM best Event | Significance* | % improvement of Best event |
| GUI | 0.29 | B | 0.29 | B | | 0.08 | B | 0.08 | B | |
| MAB100 | 0.36 | B | 0.39 | B | 31 | 0.08 | B | 0.13 | A | 67 |
| MAB134 | 0.51 | A | 0.63 | A | 115 | 0.08 | B | 0.09 | B | 23 |
| MAB13 | 0.50 | A | 0.61 | A | 107 | 0.08 | B | 0.09 | B | 19 |
| MAB15 | 0.40 | A | 0.53 | A | 79 | 0.08 | B | 0.09 | B | 19 |
| MAB17 | 0.38 | A* | 0.44 | A | 49 | 0.10 | A | 0.13 | A | 70 |

Table 44:
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 45

| | Roots Length RGR [cm/day], Normal conditions Day 14 from planting | | | | |
|---|---|---|---|---|---|
| Gene Id | LSM | Significance* | LSM best Event | Significance* | % improvement of Best event |
| GUI | 0.11 | B | 0.11 | B | |
| MAB32 | 0.11 | B | 0.15 | A | 35 |
| MAB35 | 0.11 | B | 0.20 | A | 76 |
| MAB4 | 0.11 | B | 0.17 | A | 50 |
| MAB146 | 0.15 | A | 0.19 | A | 71 |

Table 45:
LSM = Least square mean;
% improvement = compare to control (GUI); );
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 46

| | Roots Length RGR [cm/day], Normal conditions | | | | | | | | |
|---|---|---|---|---|---|---|---|---|---|
| | Day 7 from planting | | | | | Day 10 from planting | | | |
| Gene Id | LSM | Significance* | LSM best Event | Significance* | % improvement of Best event | LSM | Significance* | LSM best Event | Significance* | % improvement of Best event |
| GUI | 0.31 | B | 0.31 | B | | 0.12 | B | 0.12 | B | |
| MAB137 | 0.33 | B | 0.40 | A | 31 | 0.11 | B | 0.12 | B | −1 |
| MAB43 | 0.33 | B | 0.44 | A | 41 | 0.11 | B | 0.12 | B | −2 |
| MAB50 | 0.39 | A | 0.42 | A | 35 | 0.13 | B | 0.17 | A | 34 |
| MAB6 | 0.30 | B | 0.41 | A | 33 | 0.12 | B | 0.18 | A | 41 |

Table 46:
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

Tables 47-48 depict analyses of Plant Fresh Weight in plants overexpressing the polynucleotides of the invention under the regulation of 6669 promoter in normal conditions. Each Table represents an independent experiment, using 4 independent events per gene. Genes not connected by same letter as the control (A, B,) are significantly different from the control.

TABLE 47

| | Plant Fresh Weight [gr], Normal conditions Day 14 from planting | | | | |
|---|---|---|---|---|---|
| Gene Id | LSM | Significance* | LSM best Event | Significance* | % improvement of Best event |
| GUI | 0.15 | B | 0.15 | B | |
| MAB15 | 0.24 | A | 0.28 | A | 93 |

TABLE 47-continued

Plant Fresh Weight [gr], Normal conditions
Day 14 from planting

| Gene Id | LSM | Significance* | LSM best Event | Significance* | % improvement of Best event |
|---|---|---|---|---|---|
| MAB17 | 0.21 | A | 0.25 | A | 73 |
| MAB18 | 0.22 | A | 0.29 | A | 101 |

Table 47:
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 48

Plant Fresh Weight [gr], Normal conditions
Day 14 from planting

| Gene Id | LSM | Significance* | LSM best Event | Significance* | % improvement of Best event |
|---|---|---|---|---|---|
| GUI | 0.20 | B | 0.20 | B | |
| MAB100 | 0.28 | A* | 0.33 | A | 62 |
| MAB134 | 0.23 | B | 0.34 | A | 64 |
| MAB13 | 0.31 | A | 0.35 | A | 73 |
| MAB15 | 0.38 | A | 0.42 | A | 106 |
| MAB17 | 0.37 | A | 0.53 | A | 159 |
| MAB3_GA | 0.28 | A* | 0.40 | A | 94 |

Table 48:
LSM = Least square mean;
% improvement = compare to control (GUI); );
A meaning significant different at P < 0.05,
A* meaning significant different at P < 0.1.
The SEQ ID NOs. of the cloned genes (according to the Gene Id) which are exogenously expressed in the plants are provided in Table 3 above.

Assay 2: Plant Growth at Nitrogen Deficiency Under Tissue Culture Conditions—

The present inventors have found the NUE (Nitrogen Utilization Efficiency) assay to be relevant for the evaluation of the ABST candidate genes, since NUE deficiency encourages root elongation, increase of root coverage and allows detecting the potential of the plant to generate a better root system under drought conditions. In addition, there are indications in the literature (Wesley et al., 2002 Journal of Experiment Botany Vol. 53, No. 366, pp. 13-25) that biological mechanisms of NUE and drought tolerance are linked.

Surface sterilized seeds are sown in basal media [50% Murashige-Skoog medium (MS) supplemented with 0.8% plant agar as solidifying agent] in the presence of Kanamycin (for selecting only transgenic plants). After sowing, plates are transferred for 2-3 days at 4° C. for stratification and then grown at 25° C. under 12-hour light 12-hour dark daily cycles for 7 to 10 days. At this time point, seedlings randomly chosen are carefully transferred to plates holding nitrogen-limiting conditions: 0.5 MS media in which the combined nitrogen concentration ($NH_4NO_3$ and $KNO_3$) is 0.75 mM (nitrogen deficient conditions) or to plates holding normal nitrogen conditions: 0.5 MS media in which the combined nitrogen concentration ($NH_4NO_3$ and $KNO_3$) is 3 mM (normal nitrogen concentration). All tissue culture experiments were grown at the same time (NUE, PEG and Normal). Results for growth under normal conditions for NUE are the same as for PEG and are presented in assay 1. Each plate contains 5 seedlings of the same event, and 3-4 different plates (replicates) for each event. For each polynucleotide of the invention at least four independent transformation events are analyzed from each construct. Plants expressing the polynucleotides of the invention are compared to the average measurement of the control plants (GUI-harboring the GUS gene under the same promoter) used in the same experiment.

Digital Imaging and Statistical Analysis—

Parameters were measured and analyzed as described in Assay 1 above.

Experimental Results—

The polynucleotide sequences of the invention were assayed for a number of desired traits.

Tables 49-53 depict analyses of Leaf Area in plants overexpressing the polynucleotides of the invention under the regulation of 6669 promoter in nitrogen deficient conditions. Each Table represents an independent experiment, using 4 independent events per gene. Genes not connected by same letter as the control (A, B) are significantly different from the control.

TABLE 49

Leaf Area [cm^2], NUE 0.75 mM

| | Day 7 from planting | | | | | Day 14 from planting | | | | |
|---|---|---|---|---|---|---|---|---|---|---|
| Gene Id | LSM | Significance* | LSM best Event | Significance* | % improvement of Best event | LSM | Significance* | LSM best Event | Significance* | % improvement of Best event |
| GUI | 0.45 | B | 0.45 | B | | 0.41 | B | 0.41 | B | |
| MAB1 | 0.49 | B | 0.65 | A | 44 | 0.50 | A | 0.55 | A | 35 |
| MAB10 | 0.46 | B | 0.62 | A | 38 | 0.51 | A | 0.69 | A | 68 |
| MAB6 | 0.42 | B | 0.53 | B | 17 | 0.49 | B | 0.61 | A | 49 |

Table 49:
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 50

| | Leaf Area [cm^2], NUE 0.75 mM | | | | | | | | |
|---|---|---|---|---|---|---|---|---|---|
| | Day 7 from planting | | | | | Day 14 from planting | | | |
| Gene Id | LSM | Significance* | LSM best Event | Significance* | % improvement of Best event | LSM | Significance* | LSM best Event | Significance* | % improvement of Best event |
| GUI | 0.23 | B | 0.23 | B | | 0.41 | B | 0.41 | B | |
| MAB1 | 0.22 | B | 0.24 | B | 5 | 0.50 | A | 0.55 | A | 35 |
| MAB15 | 0.25 | B | 0.32 | A | 43 | 0.51 | A | 0.69 | A | 68 |
| MAB17 | 0.27 | A | 0.36 | A | 57 | 0.55 | A | 0.70 | A | 72 |
| MAB18 | 0.30 | A | 0.36 | A | 57 | 0.59 | A | 0.73 | A | 80 |
| MAB35 | 0.21 | B | 0.26 | B | 14 | 0.49 | B | 0.61 | A | 49 |
| MAB146 | 0.26 | B | 0.28 | B | 23 | 0.55 | A | 0.60 | A | 48 |

Table 50:
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 51

| | Leaf Area [cm^2], NUE 0.75 mM Day 7 from planting | | | | |
|---|---|---|---|---|---|
| Gene Id | LSM | Significance* | LSM best Event | Significance* | % improvement of Best event |
| GUI | 0.34 | B | 0.34 | B | |
| MAB17 | 0.32 | B | 0.44 | A | 31 |
| MAB3_GA | 0.32 | B | 0.44 | A | 31 |

Table 51:
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 52

| | Leaf Area [cm^2], NUE 0.75 mM | | | | | | | | |
|---|---|---|---|---|---|---|---|---|---|
| | Day 7 from planting | | | | | Day 14 from planting | | | |
| Gene Id | LSM | Significance* | LSM best Event | Significance* | % improvement of Best event | LSM | Significance* | LSM best Event | Significance* | % improvement of Best event |
| GUI | 0.21 | B | 0.21 | B | | 0.63 | B | 0.63 | B | |
| MAB18 | 0.23 | B | 0.31 | A | 50 | 0.58 | B | 0.77 | A | 22 |
| MAB4 | 0.20 | B | 0.31 | A | 48 | 0.54 | B | 0.82 | A | 30 |
| MAB146 | 0.21 | B | 0.29 | A | 41 | 0.48 | C | 0.59 | B | −6 |

Table 52:
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 53

Leaf Area [cm^2], NUE 0.75 mM

| | Day 7 from planting | | | | | Day 10 from planting | | | | |
|---|---|---|---|---|---|---|---|---|---|---|
| Gene Id | LSM | Significance* | LSM best Event | Significance* | % improvement of Best event | LSM | Significance* | LSM best Event | Significance* | % improvement of Best event |
| GUI | 0.27 | B | 0.27 | B | | 0.51 | B | 0.51 | B | |
| MAB43 | 0.25 | B | 0.35 | A | 29 | 0.47 | B | 0.60 | B | 18 |
| MAB50 | 0.28 | B | 0.32 | B | 19 | 0.54 | B | 0.66 | A | 31 |
| MAB6 | 0.28 | B | 0.35 | A | 28 | 0.54 | B | 0.69 | A | 35 |
| MAB66 | 0.28 | B | 0.34 | A | 25 | 0.51 | B | 0.59 | B | 17 |
| MAB99 | 0.27 | B | 0.35 | A | 28 | 0.51 | B | 0.59 | B | 16 |

Table 53:
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

Tables 54-57 depict analyses of Roots Coverage in plants overexpressing the polynucleotides of the invention under the regulation of 6669 promoter in nitrogen deficient conditions. Each Table represents an independent experiment, using 4 independent events per gene. Genes not connected by same letter as the control (A, B,) are significantly different from the control.

TABLE 54

Roots Coverage [cm^2], NUE 0.75 mM

| | Day 7 from planting | | | | | Day 14 from planting | | | | |
|---|---|---|---|---|---|---|---|---|---|---|
| Gene Id | LSM | Significance* | LSM best Event | Significance* | % improvement of Best event | LSM | Significance* | LSM best Event | Significance* | % improvement of Best event |
| GUI | 6.18 | B | 6.18 | B | | 14.36 | B | 14.36 | B | |
| MAB1 | 73.3 | B | 8.56 | A | 39 | 13.18 | B | 16.22 | B | 13 |
| MAB10 | 7.93 | A | 10.38 | A | 68 | 13.32 | B | 14.67 | B | 2 |
| MAB25 | 5.83 | B | 6.93 | B | 12 | 11.12 | A | 13.90 | B | −3 |
| MAB44 | 5.37 | B | 9.93 | A | 61 | 11.14 | A | 17.59 | B | 22 |
| MAB6 | 6.88 | B | 9.31 | A | 51 | 12.79 | B | 15.66 | B | 9 |

Table 54:
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 55

Roots Coverage [cm^2], NUE 0.75 mM

| | Day 7 from planting | | | | | Day 14 from planting | | | | |
|---|---|---|---|---|---|---|---|---|---|---|
| Gene Id | LSM | Significance* | LSM best Event | Significance* | % improvement of Best event | LSM | Significance* | LSM best Event | Significance* | % improvement of Best event |
| GUI | 4.04 | B | 4.04 | B | | 12.24 | B | 12.24 | B | |
| MAB15 | 4.53 | B | 5.60 | A | 39 | 13.70 | B | 16.40 | A | 34 |
| MAB17 | 4.15 | B | 4.85 | B | 20 | 13.16 | B | 15.06 | A | 23 |
| MAB18 | 5.23 | A | 6.79 | A | 68 | 14.47 | A | 15.52 | A | 27 |
| MAB35 | 4.03 | B | 4.90 | B | 21 | 13.95 | B | 15.62 | A | 28 |
| MAB146 | 5.10 | B | 7.01 | A | 73 | 14.65 | A | 15.70 | A | 28 |

Table 55;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 56

Roots Coverage [cm^2], NUE 0.75 mM

| | Day 7 from planting | | | | | Day 14 from planting | | | | |
|---|---|---|---|---|---|---|---|---|---|---|
| Gene Id | LSM | Significance* | LSM best Event | Significance* | % improvement of Best event | LSM | Significance* | LSM best Event | Significance* | % improvement of Best event |
| GUI | 3.14 | B | 3.14 | B | | 10.88 | B | 10.88 | B | |
| MAB18 | 5.39 | A | 7.64 | A | 144 | 12.76 | B | 16.64 | A | 53 |
| MAB32 | 3.58 | B | 7.13 | A | 127 | 9.79 | B | 16.22 | A | 49 |
| MAB35 | 5.00 | A | 6.49 | A | 107 | 13.31 | A | 15.36 | A | 41 |
| MAB4 | 4.16 | B | 7.34 | A | 134 | 12.00 | B | 16.52 | A | 52 |
| MAB46 | 3.01 | B | 3.78 | B | 21 | 8.35 | C | 12.09 | B | 11 |
| MAB146 | 4.22 | B | 7.34 | A | 134 | 11.48 | B | 14.98 | A | 38 |

Table 56;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 57

Roots Coverage [cm^2], NUE 0.75 mM

| | Day 7 from planting | | | | | Day 10 from planting | | | | |
|---|---|---|---|---|---|---|---|---|---|---|
| Gene Id | LSM | Significance* | LSM best Event | Significance* | % improvement of Best event | LSM | Significance* | LSM best Event | Significance* | % improvement of Best event |
| GUI | 4.56 | B | 4.56 | B | | 9.81 | B | 9.81 | B | |
| MAB6 | 5.66 | A | 7.98 | A | 75 | 10.61 | B | 14.87 | A | 52 |
| MAB66 | 5.83 | A | 6.58 | A | 44 | 10.31 | B | 11.49 | B | 17 |

Table 57;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

Tables 58-61 depict analyses of Roots Length in plants overexpressing the polynucleotides of the invention under the regulation of 6669 promoter in nitrogen deficient conditions. Each Table represents an independent experiment, using 4 independent events per gene. Genes not connected by same letter as the control (A, B,) are significantly different from the control.

TABLE 58

Roots Length [cm], NUE 0.75 mM
Day 7 from planting

| Gene Id | LSM | Significance* | LSM best Event | Significance* | % improvement of Best event |
|---|---|---|---|---|---|
| GUI | 6.31 | B | 6.31 | B | |
| MAB44 | 5.34 | B | 7.07 | A | 12 |

Table 58;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 59

Roots Length [cm], NUE 0.75 mM

| Gene Id | Day 7 from planting | | | | | Day 14 from planting | | | | |
|---|---|---|---|---|---|---|---|---|---|---|
| | LSM | Significance* | LSM best Event | Significance* | % improvement of Best event | LSM | Significance* | LSM best Event | Significance* | % improvement of Best event |
| GUI | 4.55 | B | 4.55 | B | | 7.23 | B | 7.23 | B | |
| MAB15 | 4.48 | B | 5.40 | A | 19 | 6.93 | B | 7.49 | B | 4 |
| MAB18 | 4.61 | B | 5.48 | A | 20 | 7.59 | B | 7.86 | B | 9 |
| MAB146 | 4.70 | B | 5.20 | B | 14 | 7.66 | B | 7.95 | A | 10 |

Table 59;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 60

Roots Length [cm], NUE 0.75 mM

| Gene Id | Day 7 from planting | | | | | Day 14 from planting | | | | |
|---|---|---|---|---|---|---|---|---|---|---|
| | LSM | Significance* | LSM best Event | Significance* | % improvement of Best event | LSM | Significance* | LSM best Event | Significance* | % improvement of Best event |
| GUI | 3.61 | B | 3.61 | B | | 6.15 | B | 6.15 | B | |
| MAB18 | 4.93 | A | 6.44 | A | 79 | 7.30 | A | 8.11 | A | 32 |
| MAB32 | 4.02 | B | 6.48 | A | 80 | 6.53 | B | 8.51 | A | 38 |
| MAB35 | 4.70 | A | 5.47 | A | 52 | 7.20 | A | 7.46 | A | 21 |
| MAB4 | 4.06 | A* | 5.54 | A | 54 | 6.60 | B | 8.02 | A | 30 |
| MAB146 | 3.77 | B | 5.54 | A | 54 | 60.9 | B | 7.19 | A | 17 |

Table 60;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 61

Roots Length [cm], NUE 0.75 mM
Day 7 from planting

| Gene Id | LSM | Significance* | LSM best Event | Significance* | % improvement of Best event |
|---|---|---|---|---|---|
| GUI | 4.87 | B | 4.87 | B | |
| MAB66 | 5.27 | B | 5.74 | A | 18 |

Table 61;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

Tables 62-64 depict analyses of Leaf Area RGR in plants overexpressing the polynucleotides of the invention under the regulation of 6669 promoter in nitrogen deficient conditions. Each Table represents an independent experiment, using 4 independent events per gene. Genes not connected by same letter as the control (A, B,) are significantly different from the control.

TABLE 62

Leaf area RGR [cm/day], NUE 0.75 mM

| | Day 7 from planting | | | | | Day 14 from planting | | | | |
|---|---|---|---|---|---|---|---|---|---|---|
| Gene Id | LSM | Significance* | LSM best Event | Significance* | % improvement of Best event | LSM | Significance* | LSM best Event | Significance* | % improvement of Best event |
| GUI | 0.46 | B | 0.46 | B | | 0.12 | B | 0.12 | B | |
| MAB1 | 0.68 | A | 1.47 | A | 222 | 0.20 | A | 0.30 | A | 151 |
| MAB17 | 0.43 | B | 0.50 | B | 8 | 0.17 | B | 0.29 | A | 145 |
| MAB35 | 0.65 | A | 0.71 | A | 54 | 0.19 | A | 0.23 | A | 93 |
| MAB146 | 0.55 | B | 0.80 | A | 75 | 0.16 | B | 0.20 | B | 66 |

Table 62;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 63

Leaf area RGR [cm/day], NUE 0.75 mM
Day 7 from planting

| Gene Id | LSM | Significance* | LSM best Event | Significance* | % improvement of Best event |
|---|---|---|---|---|---|
| GUI | 0.80 | B | 0.80 | B | |
| MAB18 | 0.87 | B | 1.24 | A | 56 |
| MAB32 | 0.94 | B | 1.53 | A | 91 |
| MAB35 | 0.96 | B | 1.21 | A | 51 |
| MAB4 | 0.71 | B | 0.81 | B | 1 |
| MAB46 | 0.64 | B | 0.75 | B | −7 |
| MAB146 | 0.82 | B | 1.04 | B | 30 |

Table 63;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 64

Leaf area RGR [cm/day], NUE 0.75 mM

| | Day 7 from planting | | | | | Day 10 from planting | | | | |
|---|---|---|---|---|---|---|---|---|---|---|
| Gene Id | LSM | Significance* | LSM best Event | Significance* | % improvement of Best event | LSM | Significance* | LSM best Event | Significance* | % improvement of Best event |
| GUI | 1.22 | B | 1.22 | B | | 0.28 | B | 0.28 | B | |
| MAB137 | 2.12 | B | 5.12 | A | 319 | 0.29 | B | 0.35 | B | 25 |
| MAB43 | 1.94 | B | 5.18 | A | 323 | 0.29 | B | 0.35 | B | 28 |
| MAB50 | 1.15 | B | 1.76 | B | 44 | 0.32 | B | 0.41 | A | 50 |

Table 64;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

Tables 65-69 depict analyses of Roots Coverage RGR in plants overexpressing the polynucleotides of the invention under the regulation of 6669 promoter in nitrogen deficient conditions. Each Table represents an independent experiment, using 4 independent events per gene. Genes not connected by same letter as the control (A, B, C) are significantly different from the control.

TABLE 65

| | Roots Coverage RGR [cm/day], NUE 0.75 mM | | | | | | | | |
|---|---|---|---|---|---|---|---|---|---|
| | Day 7 from planting | | | | | Day 14 from planting | | | |
| Gene Id | LSM | Significance* | LSM best Event | Significance* | % improvement of Best event | LSM | Significance* | LSM best Event | Significance* | % improvement of Best event |
| GUI | 5.35 | B | 5.35 | B | | 0.28 | B | 0.28 | B | |
| MAB25 | 7.38 | B | 11.62 | A | 117 | 0.19 | C | 0.26 | B | −6 |
| MAB44 | 7.19 | B | 11.52 | A | 115 | 0.26 | B | 0.35 | B | 23 |

Table 65;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 66

| | Roots Coverage RGR [cm/day], NUE 0.75 mM | | | | | | | | |
|---|---|---|---|---|---|---|---|---|---|
| | Day 7 from planting | | | | | Day 14 from planting | | | |
| Gene Id | LSM | Significance* | LSM best Event | Significance* | % improvement of Best event | LSM | Significance* | LSM best Event | Significance* | % improvement of Best event |
| GUI | 0.43 | B | 0.43 | B | | 0.30 | B | 0.30 | B | |
| MAB1 | 2.16 | A | 3.09 | A | 621 | 0.36 | B | 0.43 | A | 44 |
| MAB15 | 1.55 | A | 2.81 | A | 555 | 0.30 | B | 0.33 | B | 9 |
| MAB17 | 1.99 | A | 4.08 | A | 852 | 0.35 | B | 0.53 | A | 78 |
| MAB18 | 1.44 | A | 1.90 | A | 343 | 0.29 | B | 0.36 | B | 19 |
| MAB35 | 1.10 | B | 1.71 | B | 298 | 0.37 | B | 0.48 | A | 59 |
| MAB146 | 2.16 | A | 4.03 | A | 841 | 0.30 | B | 0.41 | A | 38 |

Table 66;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 67

| | Roots Coverage RGR [cm/day], NUE 0.75 mM | | | |
|---|---|---|---|---|
| | Day 7 from planting | | | |
| Gene Id | LSM | Significance* | LSM best Event | Significance* | % improvement of Best event |
| GUI | 2.30 | B | 2.30 | B | |
| MAB100 | 2.85 | B | 4.02 | A | 74 |
| MAB134 | 4.27 | A | 5.99 | A | 160 |
| MAB13 | 3.95 | A | 4.84 | A | 110 |
| MAB15 | 3.05 | A* | 3.97 | A | 73 |
| MAB17 | 2.96 | B | 3.76 | A | 63 |

Table 67;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 68

Roots Coverage RGR [cm/day], NUE 0.75 mM

| | Day 7 from planting | | | | | Day 14 from planting | | | | |
|---|---|---|---|---|---|---|---|---|---|---|
| Gene Id | LSM | Significance* | LSM best Event | Significance* | % improvement of Best event | LSM | Significance* | LSM best Event | Significance* | % improvement of Best event |
| GUI | 2.28 | B | 2.28 | B | | 0.44 | B | 0.44 | B | |
| MAB35 | 2.02 | B | 4.82 | A | 111 | 0.33 | B | 0.53 | B | 20 |
| MAB4 | 1.80 | B | 2.90 | B | 27 | 0.40 | B | 0.63 | A | 42 |

Table 68;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 69

Roots Coverage RGR [cm/day], NUE 0.75 mM
Day 7 from planting

| Gene Id | LSM | Significance* | LSM best Event | Significance* | % improvement of Best event |
|---|---|---|---|---|---|
| GUI | 1.60 | B | 1.60 | B | |
| MAB137 | 2.19 | A | 2.55 | B | 60 |
| MAB43 | 2.00 | B | 2.75 | A | 72 |
| MAB50 | 2.26 | A | 3.28 | A | 105 |
| MAB6 | 2.45 | A | 2.96 | A | 85 |
| MAB66 | 1.81 | B | 2.87 | A | 80 |
| MAB99 | 2.25 | A | 3.73 | A | 133 |

Table 69;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

Tables 70-74 depict analyses of Roots Length RGR in plants overexpressing the polynucleotides of the invention under the regulation of 6669 promoter in nitrogen deficient conditions. Each Table represents an independent experiment, using 4 independent events per gene. Genes not connected by same letter as the control (A, B,) are significantly different from the control.

TABLE 70

Roots Length RGR [cm/day], NUE 0.75 mM

| | Day 7 from planting | | | | | Day 14 from planting | | | | |
|---|---|---|---|---|---|---|---|---|---|---|
| Gene Id | LSM | Significance* | LSM best Event | Significance* | % improvement of Best event | LSM | Significance* | LSM best Event | Significance* | % improvement of Best event |
| GUI | 0.99 | B | 0.99 | B | | 0.04 | B | 0.04 | B | |
| MAB44 | 1.10 | B | 1.64 | A | 65 | 0.06 | B | 0.09 | A | 108 |

Table 70;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 71

Roots Length RGR [cm/day], NUE 0.75 mM

| | Day 7 from planting | | | | | Day 14 from planting | | | | |
|---|---|---|---|---|---|---|---|---|---|---|
| Gene Id | LSM | Significance* | LSM best Event | Significance* | % improvement of Best event | LSM | Significance* | LSM best Event | Significance* | % improvement of Best event |
| GUI | 0.23 | B | 0.23 | B | | 0.09 | B | 0.09 | B | |
| MAB1 | 0.46 | A | 0.58 | A | 148 | 0.12 | A | 0.14 | A | 58 |
| MAB15 | 0.43 | A | 0.58 | A | 148 | 0.08 | B | 0.10 | B | 16 |
| MAB17 | 0.45 | A | 0.57 | A | 147 | 0.11 | A | 0.16 | A | 87 |
| MAB18 | 0.41 | A | 0.44 | A | 89 | 0.10 | B | 0.13 | A | 45 |
| MAB35 | 0.31 | B | 0.37 | A | 59 | 0.10 | B | 0.13 | A | 51 |

Table 71;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 72

Roots Length RGR [cm/day], NUE 0.75 mM

| | Day 7 from planting | | | | | Day 14 from planting | | | | |
|---|---|---|---|---|---|---|---|---|---|---|
| Gene Id | LSM | Significance* | LSM best Event | Significance* | % improvement of Best event | LSM | Significance* | LSM best Event | Significance* | % improvement of Best event |
| GUI | 0.35 | B | 0.35 | B | | 0.06 | B | 0.06 | B | |
| MAB100 | 0.46 | A | 0.61 | A | 73 | 0.08 | B | 0.11 | A | 80 |
| MAB134 | 0.62 | A | 0.73 | A | 107 | 0.09 | A | 0.10 | A | 60 |
| MAB13 | 0.69 | A | 0.84 | A | 140 | 0.08 | B | 0.11 | A | 66 |
| MAB15 | 0.52 | A | 0.58 | A | 66 | 0.07 | B | 0.09 | B | 44 |
| MAB17 | 0.52 | A | 0.64 | A | 81 | 0.08 | B | 0.09 | A | 44 |
| MAB3_GA | 0.44 | B | 0.51 | A | 46 | 0.07 | B | 0.09 | B | 38 |

Table 72;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 73

Roots Length RGR [cm/day], NUE 0.75 mM

| | Day 7 from planting | | | | | Day 14 from planting | | | | |
|---|---|---|---|---|---|---|---|---|---|---|
| Gene Id | LSM | Significance* | LSM best Event | Significance* | % improvement of Best event | LSM | Significance* | LSM best Event | Significance* | % improvement of Best event |
| GUI | 0.61 | B | 0.61 | B | | 0.12 | B | 0.12 | B | |
| MAB35 | 0.52 | B | 0.91 | A | 48 | 0.10 | B | 0.16 | B | 29 |
| MAB4 | 0.53 | B | 0.65 | B | 6 | 0.12 | B | 0.19 | A | 52 |
| MAB146 | 0.37 | C | 0.42 | B | −31 | 0.12 | B | 0.17 | A | 39 |

Table 73;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 74

Roots Length RGR [cm/day], NUE 0.75 mM

| | | Day 7 from planting | | | | | Day 10 from planting | | | |
|---|---|---|---|---|---|---|---|---|---|---|
| Gene Id | LSM | Significance* | LSM best Event | Significance* | % improvement of Best event | LSM | Significance* | LSM best Event | Significance* | % improvement of Best event |
| GUI | 0.36 | B | 0.36 | B | | 0.11 | B | 0.11 | B | |
| MAB137 | 0.46 | A | 0.55 | A | 52 | 0.13 | B | 0.18 | A | 72 |
| MAB43 | 0.41 | B | 0.53 | A | 47 | 0.12 | B | 0.14 | B | 30 |
| MAB50 | 0.48 | A | 0.57 | A | 59 | 0.12 | B | 0.16 | A | 46 |
| MAB6 | 0.53 | A | 0.64 | A | 79 | 0.10 | B | 0.12 | B | 9 |
| MAB66 | 0.41 | B | 0.55 | A | 54 | 0.10 | B | 0.12 | B | 9 |
| MAB99 | 0.47 | A | 0.62 | A | 74 | 0.10 | B | 0.13 | B | 19 |

Table 74;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

Tables 75-76 depict analyses of Plant Fresh Weight in plants overexpressing the polynucleotides of the invention under the regulation of 6669 promoter in nitrogen deficient conditions. Each Table represents an independent experiment, using 4 independent events per gene. Genes not connected by same letter as the control (A, B,) are significantly different from the control.

TABLE 75

Plant Fresh Weight [gr], NUE 0.75 mM
Day 14 from planting

| Gene Id | LSM | Significance* | LSM best Event | Significance* | % improvement of Best event |
|---|---|---|---|---|---|
| GUI | 0.15 | B | | | |
| MAB1 | 0.25 | A | 0.46 | A | 208 |
| MAB6 | 0.20 | B | 0.29 | A | 95 |

Table 75;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 76

Plant Fresh Weight [gr], NUE 0.75 mM
Day 10 from planting

| Gene Id | LSM | Significance* | LSM best Event | Significance* | % improvement of Best event |
|---|---|---|---|---|---|
| GUI | 0.15 | B | | | |
| MAB137 | 0.18 | A | 0.19 | A | 31 |
| MAB50 | 0.16 | B | 0.22 | A | 49 |
| MAB6 | 0.16 | B | 0.22 | A | 52 |
| MAB66 | 0.15 | B | 0.19 | A | 32 |

Table 76;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

Example 7

Improved ABST in Greenhouse Assay

ABS Tolerance: Yield and Plant Growth Rate at High Salinity Concentration Under Greenhouse Conditions—

This assay follows the rosette area growth of plants grown in the greenhouse as well as seed yield at high salinity irrigation. Seeds were sown in agar media supplemented only with a selection agent (Kanamycin) and Hoagland solution under nursery conditions. The $T_2$ transgenic seedlings are then transplanted to 1.7 trays filled with peat and perlite. The trails were irrigated with tap water (provided from the pots' bottom). Half of the plants are irrigated with a salt solution (40-80 mM NaCl and 5 mM $CaCl_2$) to induce salinity stress (stress conditions). The other half of the plants are continued to be irrigated with tap water (normal conditions). All plants are grown in the greenhouse until plants reach the mature seeds stage, then harvested (the above ground tissue) and weighted (immediately or following drying in oven at 50° C. for 24 hour). High salinity conditions are achieved by irrigation with a solution containing 40-80 mM NaCl ("ABS" growth conditions) and are compared to regular growth conditions.

The plants were analyzed for their overall size, growth rate, seed yield, and weight of 1,000 seeds, dry matter and harvest index (HI-seed yield/dry matter). Transgenic plants performance was compared to control plants grown in parallel under the same conditions. Mock-transgenic plants expressing the uidA reporter gene (GUS Intron—GUI) under the same promoter were used as control.

The experiment is planned in nested randomized plot distribution. High salinity conditions are achieved by irrigation with a solution containing 40-80 mM NaCl ("ABS" growth conditions).

Digital Imaging—

A laboratory image acquisition system, which consists of a digital reflex camera (Canon EOS 300D) attached with a 55 mm focal length lens (Canon EF-S series), mounted on a reproduction device (Kaiser RS), which included 4 light units (4×150 Watts light bulb) was used for capturing images of plantlets.

The image capturing process was repeated every 2-3 days starting at day 1 after sowing till day 10. The same camera attached with a 24 mm focal length lens (Canon EF series), placed in a custom made iron mount, was used for capturing images of larger plants sawn in white tubs in an environmental controlled greenhouse (as seen on FIGS. 2a-b). The tubs were square shape include 1.7 liter trays. During the capture process, the trays were placed beneath the iron mount, while avoiding direct sun light and casting of shadows. This process was repeated every 2-3 days for up to 10 days.

An image analysis system was used, which consists of a personal desktop computer (Intel P4 3.0 GHz processor) and a public domain program—ImageJ 1.37 (Java based image processing program which was developed at the U.S National Institutes of Health and freely available on the internet at Hypertext Transfer Protocol://rsbweb (dot) nih (dot) gov/). Images were captured in resolution of 6 Mega Pixels (3072× 2048 pixels) and stored in a low compression JPEG (Joint Photographic Experts Group standard) format. Next, analyzed data was saved to text files and processed using the JMP statistical analysis software (SAS institute).

Vegetative Parameters Analysis—

Using the digital analysis leaves data was calculated, including leaf Average area, Rosette diameter and rosette area. The Relative Growth Rate (RGR) for the rosette parameters was calculated according to Formula I as described in Example 6. On day 80 from sowing, the plants were harvested and left to dry at 30° C. in a drying chamber. The biomass and seed weight of each plot was separated, measured and divided by the number of plants. Dry weight=total weight of the vegetative portion above ground (excluding roots) after drying at 30° C. in a drying chamber; Seed yield per plant=total seed weight per plant (gr).

The weight of 1000 seeds was determine as follows: seeds were scattered on a glass tray and a picture was taken. Each sample was weighted and then using the digital analysis, the number of seeds in each sample was calculated. 1000 seeds weight was calculated using formula II:

1000 Seed Weight=number of seed in sample/sample weight×1000    Formula II

Harvest Index—The harvest index was calculated using Formula III

Harvest Index=Average seed yield per plant/Average dry weight    Formula III

Each construct is validated in its T2 generation. Transgenic plants expressing the uidA reporter gene (GUI) under the same promoter are used as control.

Statistical Analyses—

To identify genes conferring significantly improved tolerance to abiotic stresses or enlarged root architecture, the results obtained from the transgenic plants are compared to those obtained from control plants. To identify outperforming genes and constructs, results from the independent transformation events tested are analyzed separately. In addition, genes and constructs are also analyzed taking into consideration the results obtained from all the independent transformation events tested the specific construct. For gene versus control analysis Student's t test were applied, using significance of P<0.05 or P<0.1. The JMP statistics software package is used (Version 5.2.1, SAS Institute Inc., Cary, N.C., USA).

Experimental Results

The polynucleotide sequences of the invention were assayed for a number of desired traits.

Tables 77-86 depict analyses of Rosette Area in plants overexpressing the polynucleotides of the invention under the regulation of 6669 promoter. Each Table represents an independent experiment, using 4 independent events per gene. Genes not connected by same letter as the control (A, B,) are significantly different from the control.

TABLE 77

Rosette Area [cm^2]
80 mM NaCl, Day 3 from planting

| Gene Id | LSM | Significance | LSM of Best event | Significance | % improvement of best event |
|---|---|---|---|---|---|
| GUI | 0.58 | B | 0.58 | B | |
| MAB20 | 0.59 | B | 0.84 | A | 43 |
| MAB50 | 0.57 | B | 0.88 | A | 51 |

Table 77;

LSM = Least square mean;

% improvement = compare to control (GUI);

A meaning significant different at P < 0.05,

A* meaning significant different at P < 0.1.

The SEQ ID NOs. of the cloned genes (according to the Gene Id) which are exogenously expressed in the plants are provided in Table 3 above.

TABLE 78

Rosette Area [cm^2]
80 mM NaCl, Day 5 from planting

| Gene Id | LSM | Significance | LSM of Best event | Significance | % improvement of best event |
|---|---|---|---|---|---|
| GUI | 1.27 | B | 1.27 | B | |
| MAB20 | 1.20 | B | 1.73 | a | 36 |
| MAB50 | 1.21 | B | 2.04 | a | 61 |

Table 78;

LSM = Least square mean;

% improvement = compare to control (GUI);

A meaning significant different at P < 0.05,

A* meaning significant different at P < 0.1.

The SEQ ID NOs. of the cloned genes (according to the Gene Id) which are exogenously expressed in the plants are provided in Table 3 above.

TABLE 79

Rosette Area [cm^2]
80 mM NaCl, Day 8 from planting

| Gene Id | LSM | Significance | LSM of Best event | Significance | % improvement of best event |
|---|---|---|---|---|---|
| GUI | 3.62 | B | 3.62 | B | |
| MAB20 | 3.97 | B | 5.18 | A | 43 |
| MAB50 | 3.88 | B | 6.11 | A | 69 |

Table 79;

LSM = Least square mean;

% improvement = compare to control (GUI);

A meaning significant different at P < 0.05,

A* meaning significant different at P < 0.1.

The SEQ ID NOs. of the cloned genes (according to the Gene Id) which are exogenously expressed in the plants are provided in Table 3 above.

TABLE 80

Rosette Area [cm^2]
80 mM NaCl, Day 10 from planting

| Gene Id | LSM | Significance | LSM of Best event | Significance | % improvement of best event |
|---|---|---|---|---|---|
| GUI | 7.22 | B | 7.22 | B | |
| MAB50 | 6.75 | B | 10.18 | A | 41 |

Table 80;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 81

Rosette Area [cm^2]
80 mM NaCl, Day 3 from planting

| Gene Id | LSM | Significance | LSM of Best event | Significance | % improvement of best event |
|---|---|---|---|---|---|
| GUI | 1.63 | B | 1.63 | B | |
| MAB1 | 2.03 | A | 2.29 | A | 40 |
| MAB6 | 1.34 | B | 2.40 | A | 47 |

Table 78;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 82

Rosette Area [cm^2]
80 mM NaCl, Day 5 from planting

| Gene Id | LSM | Significance | LSM of Best event | Significance | % improvement of best event |
|---|---|---|---|---|---|
| GUI | 2.88 | B | 2.88 | B | |
| MAB1 | 3.41 | A* | 3.76 | A | 31 |

Table 82;
LSM = Least square mean;
% improvement = compare to control (GUI);
A meaning significant different at P < 0.05,
A* meaning significant different at P < 0.1;.
The SEQ ID NOs. of the cloned genes (according to the Gene Id) which are exogenously expressed in the plants are provided in Table 3 above.

TABLE 83

Rosette Area [cm^2]
80 mM NaCl, Day 3 from planting

| Gene Id | LSM | Significance | LSM of Best event | Significance | % improvement of best event |
|---|---|---|---|---|---|
| GUI | 0.73 | B | 0.73 | B | |
| MAB1 | 0.77 | B | 0.91 | A | 25 |

Table 83;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 84

Rosette Area [cm^2]
80 mM NaCl, Day 5 from planting

| Gene Id | LSM | Significance | LSM of Best event | Significance | % improvement of best event |
|---|---|---|---|---|---|
| GUI | 1.41 | B | 1.41 | B | |
| MAB1 | 1.62 | A* | 2.02 | A | 44 |
| MAB17 | 1.14 | B | 1.80 | A | 28 |

Table 84;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 85

Rosette Area [cm^2]
80 mM NaCl, Day 8 from planting

| Gene Id | LSM | Significance | LSM of Best event | Significance | % improvement of best event |
|---|---|---|---|---|---|
| GUI | 2.37 | B | 2.37 | B | |
| MAB1 | 2.59 | B | 3.56 | A | 50 |
| MAB13 | 2.45 | B | 3.44 | A | 45 |
| MAB17 | 1.96 | C | 3.10 | A | 31 |

Table 85;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 86

Rosette Area [cm^2]
80 mM NaCl, Day 10 from planting

| Gene Id | LSM | Significance | LSM of Best event | Significance | % improvement of best event |
|---|---|---|---|---|---|
| GUI | 4.67 | B | 4.67 | B | |
| MAB1 | 5.37 | A* | 7.93 | A | 70 |
| MAB15 | 4.78 | B | 6.08 | A | 30 |
| MAB17 | 4.02 | B | 6.19 | A | 32 |
| MAB3_GA | 4.39 | B | 6.07 | A | 30 |

Table 86;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

Tables 87-96 depict analyses of Rosette Diameter in plants overexpressing the polynucleotides of the invention under the regulation of 6669 promoter. Each Table represents an independent experiment, using 4 independent events per gene. Genes not connected by same letter as the control (A, B,) are significantly different from the control.

TABLE 87

Rosette Diameter [cm]
80 mM NaCl, Day 3 from planting

| Gene Id | LSM | Significance | LSM of Best event | Significance | % improvement of best event |
|---|---|---|---|---|---|
| GUI | 1.50 | B | 1.50 | B | |
| MAB50 | 1.35 | B | 1.80 | A | 20 |

Table 87;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 88

Rosette Diameter [cm]
80 mM NaCl Day 5 from planting

| Gene Id | LSM | Significance | LSM of Best event | Significance | % improvement of best event |
|---|---|---|---|---|---|
| GUI | 2.05 | B | 2.05 | B | |
| MAB50 | 1.82 | C | 2.44 | A | 19 |

Table 88;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 89

Rosette Diameter [cm]
80 mM NaCl Day 8 from planting

| Gene Id | LSM | Significance | LSM of Best event | Significance | % improvement of best event |
|---|---|---|---|---|---|
| GUI | 3.23 | B | 3.23 | B | |
| MAB50 | 3.16 | B | 4.12 | A | 27 |

Table 89;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 90

Rosette Diameter [cm]
80 mM NaCl Day 10 from planting

| Gene Id | LSM | Significance | LSM of Best event | Significance | % improvement of best event |
|---|---|---|---|---|---|
| GUI | 4.47 | B | 4.47 | B | |
| MAB50 | 4.20 | B | 5.31 | A | 19 |

Table 90;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 91

Rosette Diameter [cm]
80 mM NaCl Day 3 from planting

| Gene Id | LSM | Significance | LSM of Best event | Significance | % improvement of best event |
|---|---|---|---|---|---|
| GUI | 2.25 | B | 2.25 | B | |
| MAB1 | 2.60 | A | 2.78 | A | 23 |

Table 91;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 92

Rosette Diameter [cm]
80 mM NaCl Day 5 from planting

| Gene Id | LSM | Significance | LSM of Best event | Significance | % improvement of best event |
|---|---|---|---|---|---|
| GUI | 2.87 | B | 2.87 | B | |
| MAB1 | 3.27 | A* | 9.25 | A | 223 |
| MAB20 | 2.63 | B | 9.69 | A | 238 |
| MAB6 | 2.51 | B | 10.00 | A | 249 |

Table 92;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 93

Rosette Diameter [cm]
80 mM NaCl Day 8 from planting

| Gene Id | LSM | Significance | LSM of Best event | Significance | % improvement of best event |
|---|---|---|---|---|---|
| GUI | 4.90 | B | 4.90 | B | |
| MAB6 | 4.35 | B | 6.26 | A | 28 |

Table 93;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 94

Rosette Diameter [cm]
80 mM NaCl Day 5 from planting

| Gene Id | LSM | Significance | LSM of Best event | Significance | % improvement of best event |
|---|---|---|---|---|---|
| GUI | 2.05 | B | 2.05 | B | |
| MAB1 | 2.22 | B | 2.55 | A | 25 |

Table 94;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 95

Rosette Diameter [cm]
80 mM NaCl Day 8 from planting

| Gene Id | LSM | Significance | LSM of Best event | Significance | % improvement of best event |
|---|---|---|---|---|---|
| GUI | 2.56 | B | 2.56 | B | |
| MAB1 | 2.78 | B | 3.29 | A | 29 |
| MAB3_GA | 2.56 | B | 3.04 | A | 19 |

Table 95;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 96

Rosette Diameter [cm]
80 mM NaCl Day 10 from planting

| Gene Id | LSM | Significance | LSM of Best event | Significance | % improvement of best event |
|---|---|---|---|---|---|
| GUI | 3.52 | B | 3.52 | B | |
| MAB1 | 3.79 | B | 4.76 | A | 35 |
| MAB17 | 3.24 | B | 4.14 | A | 17 |
| MAB3_GA | 3.44 | B | 4.12 | A | 17 |

Table 96;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

Tables 97-105 depict analyses of Leaf Average Area in plants overexpressing the polynucleotides of the invention under the regulation of 6669 promoter. Each Table represents an independent experiment, using 4 independent events per gene. Genes not connected by same letter as the control (A, B,) are significantly different from the control.

TABLE 97

Leaf Average Area [cm$^2$]
80 mM NaCl Day 3 from planting

| Gene Id | LSM | Significance | LSM of Best event | Significance | % improvement of best event |
|---|---|---|---|---|---|
| GUI | 0.10 | B | 0.10 | B | |
| MAB25 | 0.10 | B | 0.13 | A | 30 |

Table 97;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 98

Leaf Average Area [cm$^2$]
80 mM NaCl Day 5 from planting

| Gene Id | LSM | Significance | LSM of Best event | Significance | % improvement of best event |
|---|---|---|---|---|---|
| GUI | 0.16 | B | 0.16 | B | |
| MAB50 | 0.15 | B | 0.23 | A | 45 |

Table 98;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 99

Leaf Average Area [cm$^2$]
80 mM NaCl, Day 8 from planting

| Gene Id | LSM | Significance | LSM of Best event | Significance | % improvement of best event |
|---|---|---|---|---|---|
| GUI | 0.45 | B | 0.45 | B | |
| MAB50 | 0.41 | B | 0.61 | A | 34 |

Table 99;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 100

Leaf Average Area [cm$^2$]
80 mM NaCl, Day 10 from planting

| Gene Id | LSM | Significance | LSM of Best event | Significance | % improvement of best event |
|---|---|---|---|---|---|
| GUI | 0.74 | B | 0.74 | B | |
| MAB50 | 0.66 | B | 0.92 | A | 25 |

Table 100;
LSM = Least square mean;
% improvement = compare to control (GUI);
A meaning significant different at P < 0.05,
A* meaning significant different at P < 0.1.
The SEQ ID NOS. of the cloned genes (according to the Gene Id) which are exogenously expressed in the plants are provided in Table 3 above.

TABLE 101

Leaf Average Area [cm$^2$]
80 mM NaCl, Day 3 from planting

| Gene Id | LSM | Significance | LSM of Best event | Significance | % improvement of best event |
|---|---|---|---|---|---|
| GUI | 0.20 | B | 0.20 | B | |
| MAB1 | 0.25 | A | 0.28 | A | 43 |
| MAB6 | 0.18 | B | 0.30 | A | 51 |
| MAB7 | 0.23 | B | 0.27 | A | 36 |

Table 101;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 102

Leaf Average Area [cm^2]
80 mM NaCl, Day 8 from planting

| Gene Id | LSM | Significance | LSM of Best event | Significance | % improvement of best event |
|---|---|---|---|---|---|
| GUI | 0.69 | B | 0.69 | B | |
| MAB1 | 0.80 | A* | 0.86 | A* | 24 |
| MAB20 | 0.62 | B | 0.87 | A | 25 |
| MAB6 | 0.59 | B | 0.99 | A | 44 |

Table 102;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 103

Leaf Average Area [cm^2]
80 mM NaCl, Day 5 from planting

| Gene Id | LSM | Significance | LSM of Best event | Significance | % improvement of best event |
|---|---|---|---|---|---|
| GUI | 0.20 | B | 0.20 | B | |
| MAB1 | 0.22 | B | 0.27 | A | 30 |
| MAB17 | — | — | 0.25 | A | 21 |

Table 103;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 104

Leaf Average Area [cm^2]
80 mM NaCl, Day 8 from planting

| Gene Id | LSM | Significance | LSM of Best event | Significance | % improvement of best event |
|---|---|---|---|---|---|
| GUI | 0.28 | B | 0.28 | B | |
| MAB1 | 0.30 | B | 0.37 | A | 33 |
| MAB17 | 0.24 | B | 0.34 | A | 22 |

Table 104;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 105

Leaf Average Area [cm^2]
80 mM NaCl, Day 10 from planting

| Gene Id | LSM | Significance | LSM of Best event | Significance | % improvement of best event |
|---|---|---|---|---|---|
| GUI | 0.49 | B | 0.49 | B | |
| MAB1 | 0.55 | B | 0.76 | A | 53 |
| MAB15 | 0.52 | B | 0.63 | A | 26 |
| MAB17 | 0.45 | B | 0.64 | A | 28 |

Table 105;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

Tables 106-111 depict analyses of RGR Rosette Area [cm^2] of plants overexpressing the polynucleotides of the invention under the regulation of 6669 promoter. Each Table represents an independent experiment, using 4 independent events per gene. Genes not connected by same letter as the control (A, B,) are significantly different from the control.

TABLE 106

RGR of Rosette Area [cm^2]
80 mM NaCl, Day 3 from planting

| Gene Id | LSM | Significance | LSM of Best event | Significance | % improvement of best event |
|---|---|---|---|---|---|
| GUI | 0.73 | B | 0.73 | B | |
| MAB10 | 1.21 | B | 1.86 | A | 156 |
| MAB14 | 1.31 | B | 1.80 | A | 149 |
| MAB2 | 1.59 | A | 2.24 | A | 208 |
| MAB20 | 1.87 | A | 2.33 | A | 221 |
| MAB25 | 1.44 | A | 1.63 | A* | 125 |
| MAB36 | 1.49 | A | 1.89 | A | 161 |
| MAB43 | 1.73 | A | 3.85 | A | 430 |
| MAB44 | 1.76 | A | 2.51 | A | 246 |
| MAB50 | 1.37 | A* | 1.57 | A* | 117 |
| MAB9 | 1.47 | A | 1.75 | A | 141 |

Table 106;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 107

RGR of Rosette Area [cm^2]
80 mM NaCl, Day 8 from planting

| Gene Id | LSM | Significance | LSM of Best event | Significance | % improvement of best event |
|---|---|---|---|---|---|
| GUI | 0.61 | B | 0.61 | B | |
| MAB10 | 0.75 | A* | 0.91 | A | 50 |
| MAB14 | 0.79 | A | 0.86 | B | 42 |
| MAB19 | 0.78 | A | 0.85 | A | 41 |
| MAB2 | 0.80 | A | 0.93 | A | 54 |
| MAB20 | 0.79 | A | 0.98 | A | 61 |
| MAB36 | 0.83 | A | 0.95 | A | 56 |
| MAB44 | 0.75 | A* | 0.84 | A | 38 |
| MAB50 | 0.76 | A* | 0.83 | B | 38 |
| MAB6 | 0.82 | A | 0.99 | A | 64 |

TABLE 107-continued

RGR of Rosette Area [cm^2]
80 mM NaCl, Day 8 from planting

| Gene Id | LSM | Significance | LSM of Best event | Significance | % improvement of best event |
|---|---|---|---|---|---|
| MAB7 | 0.78 | A | 0.87 | A | 44 |
| MAB9 | 0.77 | A | 0.84 | A | 38 |

Table 107;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 108

RGR of Rosette Area [cm^2]
80 mM NaCl, Day 5 from planting

| Gene Id | LSM | Significance | LSM of Best event | Significance | % improvement of best event |
|---|---|---|---|---|---|
| GUI | 0.38 | B | 0.38 | B | |
| MAB6 | 0.37 | B | 0.51 | A | 33 |

Table 108;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 109

RGR of Rosette Area [cm^2]
80 mM NaCl, Day 3 from planting

| Gene Id | LSM | Significance | LSM of Best event | Significance | % improvement of best event |
|---|---|---|---|---|---|
| GUI | 0.88 | B | 0.88 | B | |
| MAB18 | 0.99 | A* | 1.24 | A | 41 |

Table 109;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 110

RGR of Rosette Area [cm^2]
80 mM NaCl, Day 5 from planting

| Gene Id | LSM | Significance | LSM of Best event | Significance | % improvement of best event |
|---|---|---|---|---|---|
| GUI | 0.47 | B | 0.47 | B | |
| MAB1 | 0.55 | A | 0.64 | A | 38 |
| MAB13 | 0.52 | A | 0.54 | A* | 16 |
| MAB17 | 0.52 | A | 0.54 | A* | 17 |
| MAB18 | 0.53 | A | 0.58 | A | 24 |
| MAB3_GA | 0.53 | A | 0.62 | A | 33 |
| MAB32 | 0.52 | A* | 0.54 | A* | 17 |
| MAB35 | 0.54 | A | 0.57 | A | 22 |
| MAB4 | 0.51 | A* | 0.51 | A* | 10 |
| MAB46 | 0.52 | A* | 0.55 | A | 19 |
| MAB146 | 0.54 | A | 0.55 | A | 19 |
| MAB99 | 0.53 | A | 0.57 | A | 23 |

Table 110;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 111

RGR of Rosette Area [cm^2]
80 mM NaCl, Day 3 from planting

| Gene Id | LSM | Significance | LSM of Best event | Significance | % improvement of best event |
|---|---|---|---|---|---|
| GUI | 0.49 | B | 0.49 | B | |
| MAB1 | 0.53 | B | 0.62 | A | 27 |
| MAB35 | 0.57 | A* | 0.59 | A* | 22 |
| MAB46 | 0.55 | B | 0.63 | A | 30 |

Table 111;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

Tables 112-118 depict analyses of RGR of Rosette Diameter in plants overexpressing the polynucleotides of the invention under the regulation of 6669 promoter. Each Table represents an independent experiment, using 4 independent events per gene. Genes not connected by same letter as the control (A, B,) are significantly different from the control.

TABLE 112

RGR of Rosette Diameter [cm])
80 mM NaCl, Day 3 from planting

| Gene Id | LSM | Significance | LSM of Best event | Significance | % improvement of best event |
|---|---|---|---|---|---|
| GUI | 0.28 | B | | | |
| MAB2 | 0.41 | B | 0.80 | A | 184 |
| MAB43 | 0.46 | B | 0.83 | A | 195 |
| MAB44 | 0.40 | B | 0.73 | A | 160 |

Table 112;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 113

RGR of Rosette Diameter [cm])
80 mM NaCl, Day 8 from planting

| Gene Id | LSM | Significance | LSM of Best event | Significance | % improvement of best event |
|---|---|---|---|---|---|
| GUI | 0.19 | B | 0.19 | B | |
| MAB1 | 0.22 | B | 0.24 | B | 25 |
| MAB10 | 0.25 | A | 0.29 | A | 49 |
| MAB14 | 0.23 | A | 0.25 | A | 31 |
| MAB19 | 0.24 | A | 0.26 | A | 37 |
| MAB2 | 0.24 | A | 0.26 | A | 34 |
| MAB20 | 0.25 | A | 0.29 | A | 52 |
| MAB25 | 0.24 | A | 0.27 | A | 42 |
| MAB36 | 0.25 | A | 0.28 | A | 45 |
| MAB43 | 0.22 | B | 0.25 | B | 28 |
| MAB50 | 0.25 | A | 0.28 | A | 46 |
| MAB6 | 0.24 | A | 0.27 | A | 41 |
| MAB7 | 0.22 | B | 0.27 | A | 38 |
| MAB9 | 0.23 | A | 0.26 | A | 34 |

Table 113;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 114

RGR of Rosette Diameter [cm])
80 mM NaCl, Day 5 from planting

| Gene Id | LSM | Significance | LSM of Best event | Significance | % improvement of best event |
|---|---|---|---|---|---|
| GUI | 0.14 | B | 0.14 | B | |
| MAB10 | 0.14 | B | 0.31 | A | 122 |
| MAB20 | 0.13 | B | 0.21 | A | 49 |
| MAB25 | 0.15 | B | 0.33 | A | 138 |
| MAB9 | 0.15 | B | 0.20 | A | 45 |

Table 114;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 115

RGR of Rosette Diameter [cm])
80 mM NaCl, Day 8 from planting

| Gene Id | LSM | Significance | LSM of Best event | Significance | % improvement of best event |
|---|---|---|---|---|---|
| GUI | 0.21 | B | 0.21 | B | |
| MAB20 | 0.23 | B | 0.34 | A | 67 |
| MAB9 | 0.22 | B | 0.44 | A | 114 |

Table 115;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 116

RGR of Rosette Diameter [cm])
80 mM NaCl, Day 3 from planting

| Gene Id | LSM | Significance | LSM of Best event | Significance | % improvement of best event |
|---|---|---|---|---|---|
| GUI | 0.34 | B | 0.34 | B | |
| MAB18 | 0.37 | B | 0.46 | A | 35 |
| MAB3_GA | 0.34 | B | 0.43 | A | 26 |
| MAB35 | 0.43 | A | 0.55 | A | 62 |
| MAB46 | 0.39 | B | 0.49 | A | 42 |
| MAB99 | 0.34 | B | 0.43 | A | 26 |

Table 116;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 117

RGR of Rosette Diameter [cm])
80 mM NaCl, Day 5 from planting

| Gene Id | LSM | Significance | LSM of Best event | Significance | % improvement of best event |
|---|---|---|---|---|---|
| GUI | 0.16 | B | 0.16 | B | |
| MAB1 | 0.22 | A | 0.26 | A | 66 |
| MAB18 | 0.20 | A* | 0.23 | A* | 44 |
| MAB46 | 0.25 | A | 0.45 | A | 185 |
| MAB146 | 0.20 | A* | 0.22 | A* | 42 |

Table 117;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 118

RGR of Rosette Diameter [cm])
80 mM NaCl, Day 8 from planting

| Gene Id | LSM | Significance | LSM of Best event | Significance | % improvement of best event |
|---|---|---|---|---|---|
| GUI | 0.08 | B | 0.08 | B | |
| MAB35 | 0.10 | B | 0.13 | A | 57 |
| MAB46 | 0.10 | B | 0.14 | A | 64 |
| MAB146 | 0.10 | B | 0.14 | A | 66 |
| MAB99 | 0.10 | B | 0.13 | A | 56 |

Table 118;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

Tables 119-121 depict analyses of RGR of Leaf Average Area [cm^2] in plants overexpressing the polynucleotides of the invention under the regulation of 6669 promoter. Each Table represents an independent experiment, using 4 independent events per gene. Genes not connected by same letter as the control (A, B,) are significantly different from the control.

TABLE 119

RGR of Mean(Leaf Average Area [cm$^2$]
80 mM NaCl, Day 3 from planting

| Gene Id | LSM | Significance | LSM of Best event | Significance | % improvement of best event |
|---|---|---|---|---|---|
| GUI | 0.35 | B | 0.35 | B | |
| MAB14 | 0.34 | B | 0.63 | A | 82 |
| MAB25 | 0.44 | B | 0.83 | A | 137 |
| MAB36 | 0.43 | B | 0.77 | A | 120 |
| MAB6 | 0.24 | B | 0.70 | A | 102 |

Table 119;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 120

RGR of Mean(Leaf Average Area [cm$^2$]
80 mM NaCl, Day 5 from planting

| Gene Id | LSM | Significance | LSM of Best event | Significance | % improvement of best event |
|---|---|---|---|---|---|
| GUI | 0.32 | B | 0.32 | B | |
| MAB10 | 0.32 | B | 0.56 | A | 74 |

Table 120;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 121

RGR of Mean (Leaf Average Area [cm$^2$]
80 mM NaCl, Day 3 from planting

| Gene Id | LSM | Significance | LSM of Best event | Significance | % improvement of best event |
|---|---|---|---|---|---|
| GUI | 0.39 | B | 0.39 | B | |
| MAB13 | 0.41 | B | 0.57 | A | 49 |
| MAB15 | 0.46 | A* | 0.54 | A | 40 |
| MAB17 | 0.46 | A* | 0.50 | A* | 30 |

Table 121;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

Table 122 depicts analyses of RGR of Leaf Average Area [cm$^2$] in plants overexpressing the polynucleotides of the invention under the regulation of 6669 promoter. Each Table represents an independent experiment, using 4 independent events per gene. Genes not connected by same letter as the control (A, B,) are significantly different from the control.

TABLE 122

RGR of Mean (Leaf Average Area [cm$^2$]
80 mM NaCl, Day 3 from planting

| Gene Id | LSM | Significance | LSM of Best event | Significance | % improvement of best event |
|---|---|---|---|---|---|
| GUI | 0.28 | B | 0.28 | B | |
| MAB2 | 0.41 | B | 0.80 | A | 184 |
| MAB43 | 0.46 | B | 0.83 | A | 195 |
| MAB44 | 0.40 | B | 0.73 | A | 160 |

Table 122;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

Table 123 depicts analyses of Plot Dry weight (DW) in plants overexpressing the polynucleotides of the invention under the regulation of 6669 promoter. Each Table represents an independent experiment, using 4 independent events per gene. Genes not connected by same letter as the control (A, B,) are significantly different from the control.

TABLE 123

Dry Weight [g]
80 mM NaCl

| Gene Id | LSM | Significance | LSM of Best event | Significance | % improvement of best event |
|---|---|---|---|---|---|
| GUI | 4.00 | B | 4.00 | B | |
| MAB1 | 4.92 | A | 6.40 | A | 60 |
| MAB134 | 4.35 | B | 5.35 | A | 34 |
| MAB15 | 4.42 | B | 5.57 | A | 39 |
| MAB18 | 4.52 | B | 5.35 | A | 34 |
| MAB3_GA | 4.53 | B | 5.47 | A | 37 |

Table 123;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

Tables 124-126 depict analyses of 1000 Seeds Weight in plants overexpressing the polynucleotides of the invention under the regulation of 6669 promoter. Each Table represents an independent experiment, using 4 independent events per gene. Genes not connected by same letter as the control (A, B,) are significantly different from the control.

TABLE 124

1000 Seeds Weight [g]
80 mM NaCl

| Gene Id | LSM | Significance | LSM of Best event | Significance | % improvement of best event |
|---|---|---|---|---|---|
| GUI | 0.02 | B | 0.02 | B | |
| MAB14 | 0.02 | B | 0.03 | A | 32 |
| MAB19 | 0.02 | B | 0.03 | A | 27 |

TABLE 124-continued

1000 Seeds Weight [g]
80 mM NaCl

| Gene Id | LSM | Significance | LSM of Best event | Significance | % improvement of best event |
|---|---|---|---|---|---|
| MAB2 | 0.02 | B | 0.03 | A | 24 |
| MAB6 | 0.03 | A | 0.03 | A | 53 |

Table 124;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 125

1000 Seeds Weight [g]
80 mM NaCl

| Gene Id | LSM | Significance | LSM of Best event | Significance | % improvement of best event |
|---|---|---|---|---|---|
| GUI | 0.02 | B | 0.02 | B | |
| MAB20 | 0.02 | A* | 0.02 | A | 17 |
| MAB25 | 0.02 | B | 0.02 | A | 20 |
| MAB6 | 0.02 | A* | 0.02 | A | 21 |
| MAB7 | 0.02 | B | 0.02 | A | 21 |
| MAB9 | 0.02 | B | 0.02 | A | 19 |

Table 125;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 126

1000 Seeds Weight [g]
80 mM NaCl

| | LSM | % improvement of best event | LSM of Best event | Significance | % improvement of best event |
|---|---|---|---|---|---|
| GUI | 0.02 | B | 0.02 | B | |
| MAB100 | 0.02 | B | 0.02 | A | 28 |
| MAB134 | 0.02 | B | 0.02 | A | 26 |
| MAB17 | 0.02 | B | 0.02 | A | 23 |
| MAB18 | 0.02 | B | 0.02 | A | 17 |
| MAB32 | 0.02 | B | 0.02 | A | 13 |
| MAB4 | 0.02 | B | 0.02 | A | 19 |
| MAB46 | 0.02 | B | 0.02 | A | 18 |
| MAB99 | 0.02 | B | 0.02 | A | 15 |

Table 126;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 127

Seed Yield per Plant [g]
80 mM NaCl

| Gene Id | LSM | Significance | LSM of Best event | Significance | % improvement of best event |
|---|---|---|---|---|---|
| GUI | 0.07 | B | 0.07 | B | |
| MAB44 | 0.11 | B | 0.22 | A | 210 |
| MAB50 | 0.11 | B | 0.19 | A | 170 |

Table 127;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 128

Seed Yield per Plant [g]
80 mM NaCl

| Gene Id | LSM | Significance | LSM of Best event | Significance | % improvement of best event |
|---|---|---|---|---|---|
| GUI | 0.09 | B | 0.09 | B | |
| MAB6 | 0.11 | A* | 0.21 | A | 142 |
| MAB9 | 0.09 | B | 0.14 | A | 59 |

Table 128;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 129

Seed Yield per Plant [g]
80 mM NaCl

| Gene Id | LSM | Significance | LSM of Best event | Significance | % improvement of best event |
|---|---|---|---|---|---|
| GUI | 0.14 | B | 0.14 | B | |
| MAB1 | 0.19 | A | 0.33 | A | 139 |
| MAB100 | 0.17 | B | 0.24 | A | 79 |

Table 129;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

Tables 127-129 depict analyses of Seed Yield per Plant in plants overexpressing the polynucleotides of the invention under the regulation of 6669 promoter. Each Table represents an independent experiment, using 4 independent events per gene. Genes not connected by same letter as the control (A, B,) are significantly different from the control.

Table 130 depicts analyses of Harvest Index in plants overexpressing the polynucleotides of the invention under the regulation of 6669 promoter. Each Table represents an independent experiment, using 4 independent events per gene. Genes not connected by same letter as the control (A, B,) are significantly different from the control.

TABLE 130

Harvest Index
80 mM NaCl

| Gene Id | LSM | Significance | LSM of Best event | Significance | % improvement of best event |
|---|---|---|---|---|---|
| GUI | 0.11 | B | 0.11 | B | |
| MAB25 | 0.16 | B | 0.26 | A | 139 |
| MAB44 | 0.20 | A* | 0.30 | A | 174 |
| MAB7 | 0.12 | B | 0.29 | A | 172 |

Table 130;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

Tables 131-140 depict analyses of Rosette Area in plants overexpressing the polynucleotides of the invention under the regulation of 6669 promoter. Each Table represents an independent experiment, using 4 independent events per gene. Genes not connected by same letter as the control (A, B,) are significantly different from the control.

TABLE 131

Rosette Area [cm^2]
Normal conditions, Day 5 from planting

| Gene Id | LSM | Significance | LSM of Best event | Significance | % improvement of best event |
|---|---|---|---|---|---|
| GUI | 1.37 | B | 1.37 | B | |
| MAB1 | 1.43 | B | 1.80 | A | 31 |
| MAB9 | 1.32 | B | 1.74 | A | 27 |

Table 131;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 132

Rosette Area [cm^2]
Normal conditions, Day 8 from planting

| Gene Id | LSM | Significance | LSM of Best event | Significance | % improvement of best event |
|---|---|---|---|---|---|
| GUI | 4.73 | B | 4.73 | B | |
| MAB1 | 4.95 | B | 6.45 | A | 36 |

Table 132;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 133

Rosette Area [cm^2]
Normal conditions, Day 10 from planting

| Gene Id | LSM | Significance | LSM of Best event | Significance | % improvement of best event |
|---|---|---|---|---|---|
| GUI | 8.45 | B | 8.45 | B | |
| MAB1 | 8.87 | B | 11.11 | A | 31 |

Table 133;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 134

Rosette Area [cm^2]
Normal conditions, Day 3 from planting

| Gene Id | LSM | Significance | LSM of Best event | Significance | % improvement of best event |
|---|---|---|---|---|---|
| GUI | 1.65 | B | 1.65 | B | |
| MAB1 | 2.09 | A | 2.27 | A | 37 |
| MAB36 | 1.65 | B | 2.58 | A | 56 |
| MAB7 | 1.83 | B | 2.81 | A | 70 |

Table 134;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 135

Rosette Area [cm^2]
Normal conditions, Day 5 from planting

| Gene Id | LSM | Significance | LSM of Best event | Significance | % improvement of best event |
|---|---|---|---|---|---|
| GUI | 2.93 | B | 2.93 | B | |
| MAB1 | 3.60 | A* | 3.78 | A* | 29 |
| MAB36 | 2.91 | B | 4.55 | A | 55 |
| MAB7 | 3.14 | B | 4.69 | A | 60 |

Table 135;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 136

Rosette Area [cm^2]
Normal conditions, Day 8 from planting

| Gene Id | LSM | Significance | LSM of Best event | Significance | % improvement of best event |
|---|---|---|---|---|---|
| GUI | 7.73 | B | 7.73 | B | |
| MAB1 | 9.77 | A | 10.58 | A | 37 |

TABLE 136-continued

Rosette Area [cm^2]
Normal conditions, Day 8 from planting

| Gene Id | LSM | Significance | LSM of Best event | Significance | % improvement of best event |
|---|---|---|---|---|---|
| MAB36 | 8.05 | B | 12.12 | A | 57 |
| MAB7 | 8.69 | B | 12.82 | A | 66 |

Table 136;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 137

Rosette Area [cm^2]
Normal conditions, Day 3 from planting

| Gene Id | LSM | Significance | LSM of Best event | Significance | % improvement of best event |
|---|---|---|---|---|---|
| GUI | 0.55 | B | 0.55 | B | |
| MAB1 | 0.58 | B | 0.81 | A | 47 |
| MAB100 | 0.60 | B | 0.74 | A | 34 |
| MAB15 | 0.65 | A* | 0.90 | A | 64 |
| MAB17 | 0.55 | B | 0.85 | A | 55 |

Table 137;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 138

Rosette Area [cm^2]
Normal conditions, Day 5 from planting

| Gene Id | LSM | Significance | LSM of Best event | Significance | % improvement of best event |
|---|---|---|---|---|---|
| GUI | 1.03 | B | 1.03 | B | |
| MAB1 | 1.17 | B | 1.54 | A | 49 |
| MAB100 | 1.18 | B | 1.46 | A | 42 |
| MAB15 | 1.23 | A | 1.67 | A | 62 |
| MAB17 | 1.01 | B | 1.59 | A | 54 |

Table 138;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 139

Rosette Area [cm^2]
Normal conditions, Day 8 from planting

| Gene Id | LSM | Significance | LSM of Best event | Significance | % improvement of best event |
|---|---|---|---|---|---|
| GUI | 2.09 | B | 2.09 | B | |
| MAB1 | 2.46 | B | 3.43 | A | 64 |
| MAB100 | 2.29 | B | 2.81 | A | 34 |
| MAB15 | 2.60 | A | 3.63 | A | 73 |
| MAB17 | 2.06 | B | 3.35 | A | 60 |

Table 139;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 140

Rosette Area [cm^2]
Normal conditions, Day 10 from planting

| Gene Id | LSM | Significance | LSM of Best event | Significance | % improvement of best event |
|---|---|---|---|---|---|
| GUI | 4.81 | B | 4.81 | B | |
| MAB1 | 5.57 | A* | 8.29 | A | 72 |
| MAB15 | 5.72 | A | 8.05 | A | 67 |
| MAB17 | 4.78 | B | 7.50 | A | 56 |

Table 140;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

Tables 141-148 depict analyses of Rosette Diameter in plants overexpressing the polynucleotides of the invention under the regulation of 6669 promoter. Each Table represents an independent experiment, using 4 independent events per gene. Genes not connected by same letter as the control (A, B,) are significantly different from the control.

TABLE 141

Rosette Diameter [cm]
Normal conditions, Day 8 from planting

| Gene Id | LSM | Significance | LSM of Best event | Significance | % improvement of best event |
|---|---|---|---|---|---|
| GUI | 3.52 | B | 3.52 | B | |
| MAB1 | 3.58 | B | 4.17 | A | 18 |

Table 141;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 142

Rosette Diameter [cm]
Normal conditions, Day 3 from planting

| Gene Id | LSM | Significance | LSM of Best event | Significance | % improvement of best event |
|---|---|---|---|---|---|
| GUI | 2.28 | B | 2.28 | B | |
| MAB36 | 2.23 | B | 2.91 | A | 28 |
| MAB7 | 2.47 | B | 3.11 | A | 36 |

Table 142;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 143

Rosette Diameter [cm]
Normal conditions 5 from planting

| Gene Id | LSM | Significance | LSM of Best event | Significance | % improvement of best event |
|---|---|---|---|---|---|
| GUI | 2.99 | B | 2.99 | B | |
| MAB7 | 3.24 | B | 4.08 | A | 36 |

Table 143;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 144

Rosette Diameter [cm]
Normal conditions, Day 8 from planting

| Gene Id | LSM | Significance | LSM of Best event | Significance | % improvement of best event |
|---|---|---|---|---|---|
| GUI | 5.00 | B | 5.00 | B | |
| MAB1 | 5.65 | A* | 5.87 | A* | 17 |
| MAB7 | 5.06 | B | 6.32 | A | 26 |

Table 144;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 145

Rosette Diameter [cm]
Normal conditions, Day 3 from planting

| Gene Id | LSM | Significance | LSM of Best event | Significance | % improvement of best event |
|---|---|---|---|---|---|
| GUI | 1.30 | B | 1.30 | B | |
| MAB15 | 1.48 | A | 1.69 | A | 30 |
| MAB17 | 1.33 | B | 1.60 | A | 23 |

Table 145;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 146

Rosette Diameter [cm]
Normal conditions, Day 5 from planting

| Gene Id | LSM | Significance | LSM of Best event | Significance | % improvement of best event |
|---|---|---|---|---|---|
| GUI | 1.87 | B | 1.87 | B | |
| MAB1 | 1.86 | B | 2.21 | A | 18 |
| MAB15 | 1.96 | B | 2.29 | A | 22 |
| MAB17 | 1.78 | B | 2.26 | A | 21 |

Table 146;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 147

Rosette Diameter [cm]
Normal conditions, Day 8 from planting

| Gene Id | LSM | Significance | LSM of Best event | Significance | % improvement of best event |
|---|---|---|---|---|---|
| GUI | 2.49 | B | | | |
| MAB1 | 2.60 | B | 3.14 | A | 26 |
| MAB15 | 2.64 | B | 3.17 | A | 27 |
| MAB17 | 2.39 | B | 3.09 | A | 24 |

Table 147;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 148

Rosette Diameter [cm]
Normal conditions, Day 10 from planting

| Gene Id | LSM | Significance | LSM of Best event | Significance | % improvement of best event |
|---|---|---|---|---|---|
| GUI | 3.49 | B | 3.49 | B | |
| MAB1 | 3.88 | A* | 4.81 | A | 38 |
| MAB15 | 3.78 | B | 4.52 | A | 29 |
| MAB17 | 3.53 | B | 4.45 | A | 27 |

Table 148;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

Tables 149-157 depict analyses of Leaf Average Area in plants overexpressing the polynucleotides of the invention under the regulation of 6669 promoter. Each Table represents an independent experiment, using 4 independent events per gene. Genes not connected by same letter as the control (A, B,) are significantly different from the control.

TABLE 149

Leaf Average Area [cm^2]
Normal conditions, Day 5 from planting

| Gene Id | LSM | Significance | LSM of Best event | Significance | % improvement of best event |
|---|---|---|---|---|---|
| GUI | 0.17 | B | 0.17 | B | |
| MAB1 | 0.17 | B | 0.21 | A | 27 |

Table 149;
LSM = Least square mean;
% improvement = compare to control (GUI);
A meaning significant different at $P < 0.05$,
A* meaning significant different at $P < 0.1$.
The SEQ ID NOs. of the cloned genes (according to the Gene Id) which are exogenously expressed in the plants are provided in Table 3 above.

TABLE 150

Leaf Average Area [cm^2]
Normal conditions, Day 8 from planting

| Gene Id | LSM | Significance | LSM of Best event | Significance | % improvement of best event |
|---|---|---|---|---|---|
| GUI | 0.51 | B | 0.51 | B | |
| MAB1 | 0.52 | B | 0.69 | A | 35 |

Table 150;
LSM = Least square mean;
% improvement = compare to control (GUI);
A meaning significant different at $P < 0.05$,
A* meaning significant different at $P < 0.1$.
The SEQ ID NOs. of the cloned genes (according to the Gene Id) which are exogenously expressed in the plants are provided in Table 3 above.

TABLE 151

Leaf Average Area [cm^2]
Normal conditions, Day 3 from planting

| Gene Id | LSM | Significance | LSM of Best event | Significance | % improvement of best event |
|---|---|---|---|---|---|
| GUI | 0.19 | B | 0.19 | B | |
| MAB1 | 0.25 | A | 0.27 | A | 38 |
| MAB36 | 0.20 | B | 0.31 | A | 58 |
| MAB7 | 0.23 | A* | 0.33 | A | 67 |

Table 151;
LSM = Least square mean;
% improvement = compare to control (GUI);
A meaning significant different at $P < 0.05$,
A* meaning significant different at $P < 0.1$.
The SEQ ID NOs. of the cloned genes (according to the Gene Id) which are exogenously expressed in the plants are provided in Table 3 above.

TABLE 152

Leaf Average Area [cm^2]
Normal conditions, Day 5 from planting

| Gene Id | LSM | Significance | LSM of Best event | Significance | % improvement of best event |
|---|---|---|---|---|---|
| GUI | 0.32 | B | 0.32 | B | |
| MAB1 | 0.38 | B | 0.43 | A | 34 |
| MAB36 | 0.32 | B | 0.46 | A | 43 |
| MAB7 | 0.33 | B | 0.47 | A | 45 |

Table 152;
LSM = Least square mean;
% improvement = compare to control (GUI);
A meaning significant different at $P < 0.05$,
A* meaning significant different at $P < 0.1$.
The SEQ ID NOs. of the cloned genes (according to the Gene Id) which are exogenously expressed in the plants are provided in Table 3 above.

TABLE 153

Leaf Average Area [cm^2]
Normal conditions, Day 8 from planting

| Gene Id | LSM | Significance | LSM of Best event | Significance | % improvement of best event |
|---|---|---|---|---|---|
| GUI | 0.69 | B | 0.69 | B | |
| MAB36 | 0.69 | B | 0.93 | A | 36 |
| MAB7 | 0.79 | B | 1.17 | A | 71 |

Table 153;
LSM = Least square mean;
% improvement = compare to control (GUI);
A meaning significant different at $P < 0.05$,
A* meaning significant different at $P < 0.1$.
The SEQ ID NOs. of the cloned genes (according to the Gene Id) which are exogenously expressed in the plants are provided in Table 3 above.

TABLE 154

Leaf Average Area [cm^2]
Normal conditions, Day 3 from planting

| Gene Id | LSM | Significance | LSM of Best event | Significance | % improvement of best event |
|---|---|---|---|---|---|
| GUI | 0.11 | B | 0.11 | B | |
| MAB1 | 0.12 | B | 0.15 | A | 28 |
| MAB15 | 0.13 | B | 0.17 | A | 53 |
| MAB17 | 0.11 | B | 0.15 | A | 34 |

Table 154;
LSM = Least square mean;
% improvement = compare to control (GUI);
A meaning significant different at $P < 0.05$,
A* meaning significant different at $P < 0.1$.
The SEQ ID NOs. of the cloned genes (according to the Gene Id) which are exogenously expressed in the plants are provided in Table 3 above.

TABLE 155

Leaf Average Area [cm^2]
Normal conditions, Day 5 from planting

| Gene Id | LSM | Significance | LSM of Best event | Significance | % improvement of best event |
|---|---|---|---|---|---|
| GUI | 0.16 | B | 0.16 | B | |
| MAB1 | 0.17 | B | 0.21 | A | 26 |
| MAB100 | 0.18 | B | 0.21 | A | 30 |

TABLE 155-continued

Leaf Average Area [cm^2]
Normal conditions, Day 5 from planting

| Gene Id | LSM | Significance | LSM of Best event | Significance | % improvement of best event |
|---|---|---|---|---|---|
| MAB15 | 0.18 | A* | 0.23 | A | 39 |
| MAB17 | 0.16 | B | 0.22 | A | 35 |

Table 155;
LSM = Least square mean;
% improvement = compare to control (GUI);
A meaning significant different at $P < 0.05$,
A* meaning significant different at $P < 0.1$.
The SEQ ID NOs. of the cloned genes (according to the Gene Id) which are exogenously expressed in the plants are provided in Table 3 above.

TABLE 156

Leaf Average Area [cm^2]
Normal conditions, Day 8 from planting

| Gene Id | LSM | Significance | LSM of Best event | Significance | % improvement of best event |
|---|---|---|---|---|---|
| GUI | 0.24 | B | 0.24 | B | |
| MAB1 | 0.28 | A* | 0.37 | A | 50 |
| MAB15 | 0.29 | A* | 0.37 | A | 53 |
| MAB17 | 0.25 | B | 0.34 | A | 40 |

Table 156;
LSM = Least square mean;
% improvement = compare to control (GUI);
A meaning significant different at $P < 0.05$,
A* meaning significant different at $P < 0.1$.
The SEQ ID NOs. of the cloned genes (according to the Gene Id) which are exogenously expressed in the plants are provided in Table 3 above.

TABLE 157

Leaf Average Area [cm^2]
Normal conditions, Day 10 from planting

| Gene Id | LSM | Significance | LSM of Best event | Significance | % improvement of best event |
|---|---|---|---|---|---|
| GUI | 0.54 | B | 0.54 | B | |
| MAB1 | 0.57 | B | 0.80 | A | 49 |
| MAB15 | 0.59 | B | 0.78 | A | 45 |
| MAB17 | 0.51 | B | 0.74 | A | 37 |

Table 157;
LSM = Least square mean;
% improvement = compare to control (GUI);
A meaning significant different at $P < 0.05$,
A* meaning significant different at $P < 0.1$.
The SEQ ID NOs. of the cloned genes (according to the Gene Id) which are exogenously expressed in the plants are provided in Table 3 above.

Tables 158-166 depict analyses of RGR Rosette Area [cm^2] of plants overexpressing the polynucleotides of the invention under the regulation of 6669 promoter. Each Table represents an independent experiment, using 4 independent events per gene. Genes not connected by same letter as the control (A, B,) are significantly different from the control.

TABLE 158

RGR of Rosette Area [cm^2]
Normal conditions, Day 3 from planting

| Gene Id | LSM | Significance | LSM of Best event | Significance | % improvement of best event |
|---|---|---|---|---|---|
| GUI | 1.73 | B | 1.73 | B | |
| MAB20 | 2.18 | B | 3.62 | A | 109 |
| MAB43 | 2.04 | B | 3.80 | A | 119 |
| MAB50 | 2.25 | B | 3.81 | A | 120 |

Table 158;
LSM = Least square mean;
% improvement = compare to control (GUI);
A meaning significant different at $P < 0.05$,
A* meaning significant different at $P < 0.1$.
The SEQ ID NOs. of the cloned genes (according to the Gene Id) which are exogenously expressed in the plants are provided in Table 3 above.

TABLE 159

RGR of Rosette Area [cm^2]
Normal conditions, Day 5 from planting

| Gene Id | LSM | Significance | LSM of Best event | Significance | % improvement of best event |
|---|---|---|---|---|---|
| GUI | 0.48 | B | 0.48 | B | |
| MAB2 | 0.58 | A* | 0.70 | A | 45 |
| MAB43 | 0.62 | A | 0.75 | A | 56 |
| MAB6 | 0.52 | B | 0.72 | A | 50 |

Table 159;
LSM = Least square mean;
% improvement = compare to control (GUI);
A meaning significant different at $P < 0.05$, A* meaning significant different at $P < 0.1$.
The SEQ ID NOs. of the cloned genes (according to the Gene Id) which are exogenously expressed in the plants are provided in Table 3 above.

TABLE 160

RGR of Rosette Area [cm^2]
Normal conditions, Day 8 from planting

| Gene Id | LSM | Significance | LSM of Best event | Significance | % improvement of best event |
|---|---|---|---|---|---|
| GUI | 0.84 | B | 0.84 | B | |
| MAB50 | 0.87 | B | 0.99 | A | 18 |
| MAB6 | 0.87 | B | 1.06 | A | 26 |

Table 160;
LSM = Least square mean;
% improvement = compare to control (GUI);
A meaning significant different at $P < 0.05$,
A* meaning significant different at $P < 0.1$.
The SEQ ID NOs. of the cloned genes (according to the Gene Id) which are exogenously expressed in the plants are provided in Table 3 above.

TABLE 161

RGR of Rosette Area [cm^2]
Normal conditions, Day 10 from planting

| Gene Id | LSM | Significance | LSM of Best event | Significance | % improvement of best event |
|---|---|---|---|---|---|
| GUI | 0.39 | B | 0.39 | B | |
| MAB10 | 0.44 | B | 0.54 | A | 37 |
| MAB36 | 0.45 | B | 0.51 | A | 30 |
| MAB50 | 0.45 | A* | 0.53 | A | 35 |

TABLE 161-continued

RGR of Rosette Area [cm^2]
Normal conditions, Day 10 from planting

| Gene Id | LSM | Significance | LSM of Best event | Significance | % improvement of best event |
|---|---|---|---|---|---|
| MAB6 | 0.44 | B | 0.60 | A | 51 |
| MAB7 | 0.43 | B | 0.50 | A | 27 |

Table 161;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 162

RGR of Rosette Area [cm^2]
Normal conditions, Day 5 from planting

| Gene Id | LSM | Significance | LSM of Best event | Significance | % improvement of best event |
|---|---|---|---|---|---|
| GUI | 0.39 | B | 0.39 | B | |
| MAB20 | 0.38 | B | 0.50 | A | 28 |
| MAB25 | 0.39 | B | 0.53 | A | 38 |

Table 162;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 163

RGR of Rosette Area [cm^2]
Normal conditions, Day 8 from planting

| Gene Id | LSM | Significance | LSM of Best event | Significance | % improvement of best event |
|---|---|---|---|---|---|
| GUI | 0.55 | B | 0.55 | B | |
| MAB10 | 0.64 | A* | 0.71 | A* | 30 |
| MAB2 | 0.63 | A* | 0.70 | A | 28 |
| MAB20 | 0.63 | A* | 0.67 | A* | 21 |
| MAB25 | 0.64 | A | 0.73 | A | 32 |
| MAB44 | 0.65 | A | 0.77 | A | 41 |
| MAB50 | 0.70 | A | 0.83 | A | 51 |
| MAB6 | 0.63 | A* | 0.81 | A | 48 |
| MAB7 | 0.61 | B | 0.73 | A | 34 |
| MAB9 | 0.60 | B | 0.69 | A | 26 |

Table 163;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 164

RGR of Rosette Area [cm^2]
Normal conditions, Day 5 from planting

| Gene Id | LSM | Significance | LSM of Best event | Significance | % improvement of best event |
|---|---|---|---|---|---|
| GUI | 0.45 | B | 0.45 | B | |
| MAB13 | 0.63 | A | 0.68 | A* | 49 |

TABLE 164-continued

RGR of Rosette Area [cm^2]
Normal conditions, Day 5 from planting

| Gene Id | LSM | Significance | LSM of Best event | Significance | % improvement of best event |
|---|---|---|---|---|---|
| MAB32 | 0.50 | B | 0.74 | A | 64 |
| MAB46 | 0.52 | B | 0.75 | A | 65 |
| MAB146 | 0.64 | A | 0.88 | A | 94 |
| MAB99 | 0.52 | B | 0.73 | A | 61 |

Table 164;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 165

RGR of Rosette Area [cm^2]
Normal conditions, Day 8 from planting

| Gene Id | LSM | Significance | LSM of Best event | Significance | % improvement of best event |
|---|---|---|---|---|---|
| GUI | 0.34 | B | 0.34 | B | |
| MAB1 | 0.36 | B | 0.45 | A | 31 |
| MAB99 | 0.33 | B | 0.43 | A | 28 |

Table 165;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 166

RGR of Rosette Area [cm^2]
Normal conditions, Day 10 from planting

| Gene Id | LSM | Significance | LSM of Best event | Significance | % improvement of best event |
|---|---|---|---|---|---|
| GUI | 0.66 | B | 0.66 | B | |
| MAB13 | 0.73 | B | 0.81 | A | 23 |
| MAB3_GA | 0.70 | B | 0.85 | A | 29 |
| MAB32 | 0.70 | B | 0.86 | A | 31 |
| MAB99 | 0.68 | B | 0.82 | A | 25 |

Table 166;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

Tables 167-175 depict analyses of RGR of Rosette Diameter in plants overexpressing the polynucleotides of the invention under the regulation of 6669 promoter. Each Table represents an independent experiment, using 4 independent events per gene. Genes not connected by same letter as the control (A, B,) are significantly different from the control.

TABLE 167

RGR of Rosette Diameter [cm])
Normal conditions, Day 3 from planting

| Gene Id | LSM | Significance | LSM of Best event | Significance | % improvement of best event |
|---|---|---|---|---|---|
| GUI | 0.43 | B | 0.43 | B | |
| MAB50 | 0.70 | A* | 1.50 | A | 251 |
| MAB6 | 0.45 | B | 1.21 | A | 183 |

Table 167;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 168

RGR of Rosette Diameter [cm])
Normal conditions, Day 5 from planting

| Gene Id | LSM | Significance | LSM of Best event | Significance | % improvement of best event |
|---|---|---|---|---|---|
| GUI | 0.16 | B | 0.16 | B | |
| MAB10 | 0.19 | A* | 0.21 | A* | 28 |
| MAB19 | 0.20 | A | 0.23 | A | 45 |
| MAB36 | 0.18 | B | 0.21 | A | 32 |
| MAB50 | 0.17 | B | 0.23 | A | 42 |
| MAB6 | 0.18 | B | 0.25 | A | 57 |
| MAB7 | 0.18 | B | 0.24 | A | 52 |

Table 168;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 169

RGR of Rosette Diameter [cm])
Normal conditions, Day 8 from planting

| Gene Id | LSM | Significance | LSM of Best event | Significance | % improvement of best event |
|---|---|---|---|---|---|
| GUI | 0.25 | B | 0.25 | B | |
| MAB10 | 0.28 | A | 0.30 | A | 19 |
| MAB14 | 0.27 | B | 0.31 | A | 23 |
| MAB19 | 0.28 | A | 0.32 | A | 29 |
| MAB2 | 0.27 | B | 0.30 | A | 21 |
| MAB20 | 0.27 | B | 0.29 | A | 18 |
| MAB36 | 0.27 | A* | 0.32 | A | 28 |
| MAB43 | 0.25 | B | 0.26 | B | 5 |
| MAB44 | 0.26 | B | 0.30 | A | 21 |
| MAB50 | 0.27 | B | 0.30 | A | 21 |
| MAB7 | 0.28 | A* | 0.29 | A | 17 |
| MAB9 | 0.27 | A* | 0.30 | A | 20 |

Table 169;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 170

RGR of Rosette Diameter [cm])
Normal conditions, Day 10 from planting

| Gene Id | LSM | Significance | LSM of Best event | Significance | % improvement of best event |
|---|---|---|---|---|---|
| GUI | 0.17 | B | 0.17 | B | |
| MAB19 | 0.19 | A* | 0.23 | A | 31 |
| MAB2 | 0.20 | A | 0.23 | A | 32 |
| MAB20 | 0.19 | A | 0.23 | A | 33 |
| MAB43 | 0.19 | B | 0.21 | A | 24 |
| MAB44 | 0.18 | B | 0.22 | A | 25 |
| MAB50 | 0.20 | A | 0.23 | A | 32 |
| MAB6 | 0.19 | A* | 0.24 | A | 42 |
| MAB9 | 0.18 | B | 0.21 | A | 25 |

Table 170;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 171

RGR of Rosette Diameter [cm])
Normal conditions, Day 5 from planting

| Gene Id | LSM | Significance | LSM of Best event | Significance | % improvement of best event |
|---|---|---|---|---|---|
| GUI | 0.16 | B | 0.16 | B | |
| MAB50 | 0.19 | B | 0.22 | A | 42 |
| MAB6 | 0.15 | B | 0.24 | A | 49 |

Table 171;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 172

RGR of Rosette Diameter [cm])
Normal conditions, Day 10 from planting

| Gene Id | LSM | Significance | LSM of Best event | Significance | % improvement of best event |
|---|---|---|---|---|---|
| GUI | 0.22 | B | 0.22 | B | |
| MAB2 | 0.26 | A* | 0.28 | A | 27 |
| MAB20 | 0.26 | B | 0.30 | A | 33 |
| MAB25 | 0.26 | A* | 0.29 | A* | 31 |
| MAB43 | 0.24 | B | 0.29 | A | 29 |
| MAB44 | 0.25 | B | 0.29 | A | 31 |

Table 172;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 173

RGR of Rosette Diameter [cm])
Normal conditions, Day 3 from planting

| Gene Id | LSM | Significance | LSM of Best event | Significance | % improvement of best event |
|---|---|---|---|---|---|
| GUI | 0.29 | B | 0.29 | B | |
| MAB100 | 0.37 | A* | 0.51 | a | 74 |
| MAB13 | 0.38 | A | 0.58 | A | 95 |
| MAB15 | 0.36 | A | 0.45 | A | 54 |
| MAB18 | 0.36 | A* | 0.38 | A* | 28 |
| MAB3_GA | 0.43 | A | 0.60 | A | 105 |
| MAB35 | 0.39 | A | 0.44 | A | 50 |
| MAB46 | 0.31 | B | 0.49 | A | 65 |
| MAB146 | 0.35 | A | 0.44 | A | 50 |

Table 173;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 174

RGR of Rosette Diameter [cm])
Normal conditions, Day 8 from planting

| Gene Id | LSM | Significance | LSM of Best event | Significance | % improvement of best event |
|---|---|---|---|---|---|
| GUI | 0.11 | B | 0.11 | B | |
| MAB1 | 0.13 | A* | 0.16 | A | 49 |
| MAB13 | 0.13 | A* | 0.16 | A | 41 |
| MAB18 | 0.14 | A | 0.16 | A | 45 |
| MAB32 | 0.13 | B | 0.15 | A | 39 |
| MAB146 | 0.16 | A | 0.19 | A | 72 |
| MAB99 | 0.12 | B | 0.15 | A | 40 |

Table 174;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 175

RGR of Rosette Diameter [cm])
Normal conditions, Day 10 from planting

| Gene Id | LSM | Significance | LSM of Best event | Significance | % improvement of best event |
|---|---|---|---|---|---|
| GUI | 0.20 | B | 0.20 | B | |
| MAB1 | 0.25 | A | 0.27 | A | 30 |
| MAB17 | 0.24 | A | 0.26 | A* | 25 |
| MAB18 | 0.25 | A | 0.31 | A | 51 |
| MAB35 | 0.25 | A | 0.28 | A | 36 |
| MAB146 | 0.25 | A | 0.28 | A | 36 |
| MAB99 | 0.24 | A | 0.29 | A | 44 |

Table 175;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

Tables 176-178 depict analyses of RGR of Leaf Average Area [cm^2] in plants overexpressing the polynucleotides of the invention under the regulation of 6669 promoter. Each Table represents an independent experiment, using 4 independent events per gene. Genes not connected by same letter as the control (A, B,) are significantly different from the control.

TABLE 176

RGR of Mean (Leaf Average Area [cm^2]
Normal conditions, Day 10 from planting

| Gene Id | LSM | Significance | LSM of Best event | Significance | % improvement of best event |
|---|---|---|---|---|---|
| GUI | 0.34 | B | 0.34 | B | |
| MAB10 | 0.35 | B | 0.52 | A | 56 |
| MAB36 | 0.40 | B | 0.52 | A | 55 |
| MAB7 | 0.37 | B | 0.50 | A | 49 |

Table 176;
LSM = Least square mean;
% improvement = compare to control (GUI).
The SEQ ID NOs. of the cloned genes (according to the Gene Id) which are exogenously expressed in the plants are provided in Table 3 above.

TABLE 177

RGR of Mean (Leaf Average Area [cm^2]
Normal conditions, Day 10 from planting

| Gene Id | LSM | Significance | LSM of Best event | Significance | % improvement of best event |
|---|---|---|---|---|---|
| GUI | 0.38 | B | 0.38 | B | |
| MAB10 | 0.47 | A | 0.51 | A* | 35 |
| MAB2 | 0.41 | B | 0.49 | A | 29 |
| MAB25 | 0.43 | B | 0.55 | A | 44 |
| MAB50 | 0.47 | A | 0.53 | A | 41 |
| MAB7 | 0.45 | A* | 0.50 | A* | 31 |
| MAB9 | 0.43 | B | 0.54 | A | 41 |

Table 177;
LSM = Least square mean;
% improvement = compare to control (GUI).
The SEQ ID NOs. of the cloned genes (according to the Gene Id) which are exogenously expressed in the plants are provided in Table 3 above.

TABLE 178

RGR of Mean (Leaf Average Area [cm^2]
Normal conditions, Day 5 from planting

| Gene Id | LSM | Significance | LSM of Best event | Significance | % improvement of best event |
|---|---|---|---|---|---|
| GUI | 0.23 | B | 0.23 | B | |
| MAB13 | 0.34 | A* | 0.39 | A* | 70 |
| MAB146 | 0.35 | A* | 0.50 | A | 117 |
| MAB99 | 0.26 | B | 0.44 | A | 89 |

Table 178;
LSM = Least square mean;
% improvement = compare to control (GUI).
The SEQ ID NOs. of the cloned genes (according to the Gene Id) which are exogenously expressed in the plants are provided in Table 3 above.

Tables 179-180 depict analyses of RGR of Leaf Average Area [cm^2] in plants overexpressing the polynucleotides of the invention under the regulation of 6669 promoter. Each Table represents an independent experiment, using 4 independent events per gene. Genes not connected by same letter as the control (A, B,) are significantly different from the control.

TABLE 179

RGR of Mean (Leaf Average Area [cm^2]
Normal conditions, Day 5 from planting

| Gene Id | LSM | Significance | LSM of Best event | Significance | % improvement of best event |
|---|---|---|---|---|---|
| GUI | 0.31 | B | 0.31 | B | |
| MAB19 | 0.35 | B | 0.48 | A | 56 |
| MAB43 | 0.39 | B | 0.52 | A | 70 |
| MAB6 | 0.28 | B | 0.50 | A | 62 |

Table 179;
LSM = Least square mean;
% improvement = compare to control (GUI);
A meaning significant different at $P < 0.05$,
A* meaning significant different at $P < 0.1$.
The SEQ ID NOs. of the cloned genes (according to the Gene Id) which are exogenously expressed in the plants are provided in Table 3 above.

TABLE 180

RGR of Mean (Leaf Average Area [cm^2]
Normal conditions, Day 8 from planting

| Gene Id | LSM | Significance | LSM of Best event | Significance | % improvement of best event |
|---|---|---|---|---|---|
| GUI | 0.69 | B | 0.69 | B | |
| MAB14 | 0.72 | B | 0.92 | A | 32 |
| MAB6 | 0.69 | B | 0.96 | A | 38 |

Table 180;
LSM = Least square mean;
% improvement = compare to control (GUI);
A meaning significant different at $P < 0.05$,
A* meaning significant different at $P < 0.1$.
The SEQ ID NOs. of the cloned genes (according to the Gene Id) which are exogenously expressed in the plants are provided in Table 3 above.

Tables 181-182 depict analyses of Plot Dry weight (DW) in plants overexpressing the polynucleotides of the invention under the regulation of 6669 promoter. Each Table represents an independent experiment, using 4 independent events per gene. Genes not connected by same letter as the control (A, B,) are significantly different from the control.

TABLE 181

Dry Weight [g]
Normal conditions

| Gene Id | LSM | Significance | LSM of Best event | Significance | % improvement of best event |
|---|---|---|---|---|---|
| GUI | 7.75 | B | 7.75 | B | |
| MAB36 | 10.37 | A* | 13.21 | A | 71 |

Table 181;
LSM = Least square mean;
% improvement = compare to control (GUI);
A meaning significant different at $P < 0.05$,
A* meaning significant different at $P < 0.1$.
The SEQ ID NOs. of the cloned genes (according to the Gene Id) which are exogenously expressed in the plants are provided in Table 3 above.

TABLE 182

Dry Weight [g]
Normal conditions

| Gene Id | LSM | Significance | LSM of Best event | Significance | % improvement of best event |
|---|---|---|---|---|---|
| GUI | 5.23 | B | 5.23 | B | |
| MAB1 | 6.81 | A | 8.09 | A | 55 |
| MAB13 | 6.08 | B | 7.61 | A | 45 |
| MAB18 | 6.10 | B | 8.18 | A | 56 |
| MAB99 | 6.51 | A* | 8.42 | A | 61 |

Table 182;
LSM = Least square mean;
% improvement = compare to control (GUI);
A meaning significant different at $P < 0.05$,
A* meaning significant different at $P < 0.1$.
The SEQ ID NOs. of the cloned genes (according to the Gene Id) which are exogenously expressed in the plants are provided in Table 3 above.

Tables 183-185 depict analyses of 1000 Seeds Weight in plants overexpressing the polynucleotides of the invention under the regulation of 6669 promoter. Each Table represents an independent experiment, using 4 independent events per gene. Genes not connected by same letter as the control (A, B,) are significantly different from the control.

TABLE 183

1000 Seeds Weight [g]
Normal conditions

| Gene Id | LSM | Significance | LSM of Best event | Significance | % improvement of best event |
|---|---|---|---|---|---|
| GUI | 0.02 | B | 0.02 | B | |
| MAB19 | 0.02 | B | 0.03 | A | 23 |
| MAB2 | 0.02 | B | 0.03 | A | 44 |
| MAB20 | 0.02 | A | 0.04 | A | 71 |
| MAB36 | 0.02 | B | 0.03 | A | 24 |
| MAB50 | 0.02 | B | 0.03 | A | 32 |
| MAB6 | 0.02 | B | 0.03 | A | 22 |
| MAB9 | 0.02 | A | 0.02 | A | 19 |

Table 183;
LSM = Least square mean;
% improvement = compare to control (GUI);
A meaning significant different at $P < 0.05$,
A* meaning significant different at $P < 0.1$.
The SEQ ID NOs. of the cloned genes (according to the Gene Id) which are exogenously expressed in the plants are provided in Table 3 above.

TABLE 184

1000 Seeds Weight [g]
Normal conditions

| Gene Id | LSM | Significance | LSM of Best event | Significance | % improvement of best event |
|---|---|---|---|---|---|
| GUI | 0.02 | B | 0.02 | B | |
| MAB20 | 0.02 | A* | 0.02 | A | 17 |
| MAB6 | 0.02 | A* | 0.02 | A | 21 |

Table 184;
LSM = Least square mean;
% improvement = compare to control (GUI);
A meaning significant different at $P < 0.05$,
A* meaning significant different at $P < 0.1$.
The SEQ ID NOs. of the cloned genes (according to the Gene Id) which are exogenously expressed in the plants are provided in Table 3 above.

TABLE 185

1000 Seeds Weight [g]
Normal conditions

| Gene Id | LSM | Significance | LSM of Best event | Significance | % improvement of best event |
|---|---|---|---|---|---|
| GUI | 0.02 | B | 0.02 | B | |
| MAB100 | 0.02 | B | 0.02 | A | 23 |
| MAB17 | 0.02 | A | 0.03 | A | 33 |
| MAB18 | 0.02 | B | 0.02 | A | 18 |
| MAB35 | 0.02 | B | 0.02 | A | 28 |
| MAB46 | 0.02 | A | 0.02 | A | 21 |
| MAB99 | 0.02 | A | 0.03 | A | 37 |

Table 185;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

Tables 186-187 depict analyses of Seed Yield per Plant in plants overexpressing the polynucleotides of the invention under the regulation of 6669 promoter. Each Table represents an independent experiment, using 4 independent events per gene. Genes not connected by same letter as the control (A, B,) are significantly different from the control.

TABLE 186

Seed Yield per Plant [g]
Normal conditions

| Gene Id | LSM | Significance | LSM of Best event | Significance | % improvement of best event |
|---|---|---|---|---|---|
| GUI | 0.38 | B | 0.38 | B | |
| MAB1 | 0.50 | B | 0.61 | A | 61 |
| MAB10 | 0.46 | B | 0.59 | A | 53 |
| MAB14 | 0.50 | A* | 0.60 | A | 57 |
| MAB36 | 0.52 | A | 0.68 | A | 77 |
| MAB50 | 0.46 | B | 0.60 | A | 56 |

Table 186;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

TABLE 187

Seed Yield per Plant [g]
Normal conditions

| Gene Id | LSM | Significance | LSM of Best event | Significance | % improvement of best event |
|---|---|---|---|---|---|
| GUI | 0.32 | B | 0.32 | B | |
| MAB1 | 0.41 | A* | 0.49 | A | 53 |
| MAB13 | 0.43 | A | 0.55 | A | 69 |
| MAB18 | 0.39 | B | 0.49 | A | 53 |
| MAB32 | 0.41 | B | 0.50 | A | 56 |
| MAB35 | 0.41 | A* | 0.50 | A | 57 |
| MAB99 | 0.41 | A* | 0.51 | A | 57 |

Table 187;
LSM = Least square mean;
% improvement = compare to control (GUI);
A meaning significant different at P < 0.05, A* meaning significant different at P < 0.1.
The SEQ ID NOs. of the cloned genes (according to the Gene Id) which are exogenously expressed in the plants is provided in Table 3 above.

Table 188 depicts analyses of Harvest Index in plants overexpressing the polynucleotides of the invention under the regulation of 6669 promoter. Each Table represents an independent experiment, using 4 independent events per gene. Genes not connected by same letter as the control (A, B,) are significantly different from the control.

TABLE 188

Harvest Index
Normal conditions

| Gene Id | LSM | Significance | LSM of Best event | Significance | % improvement of best event |
|---|---|---|---|---|---|
| GUI | 0.48 | B | 0.48 | B | |
| MAB17 | 0.46 | B | 0.62 | A | 28 |

Table 188;
LSM = Least square mean;
% improvement = compare to control (GUI);
A meaning significant different at P < 0.05,
A* meaning significant different at P < 0.1.
The SEQ ID NOs. of the cloned genes (according to the Gene Id) which are exogenously expressed in the plants are provided in Table 3 above.

Example 8

Transformation of Tomato M82 Plants with Putative ABST Genes

For the tomato transformation, tomato M82 seeds were previously sterilized with Na-hipochloride 3%+2-3 drops of Tween 20 (Polysorbate 20). Seeds were washed 3 times with distilled sterile water. Seeds were then germinated in full strength Nitsch medium and germinated for 8 days 8 days in growth room at 25° C. in the dark. Plantlets were then cut with 2-4 cm stem and insert it into a 10-cm Petri dishes that were filled with 30-40 ml of MS liquid medium. Cotyledons were then cut and used as explants and later transferred onto KCMS solidified medium with 100 μM acetosyringone in a 10-cm Petri dish. Explants were inoculated with *A. tumefascience* for 30-50 minutes. Explants were co-cultivated for 24 hours and transferred to regeneration media including Kanamycin as selection medium. The resistant regenerated plantlets were then transferred into a rooting medium for 10-14 days until the appearance of the roots.

Example 9

Growth of M82 Tomato Transformed Plants and Phenotype Characterizations

Experimental Procedures
Producing Transgenic Tomato Plants—
Plants were transformed as described in Example 8, above. Following transformation, T1 M82 tomato plants were grown until fruit set. T2 seeds have entered experiments to assess abiotic stress resistance.
Experimental Results
Assay 1—Tomato Field Trial Under Regular and Water Deficient Regimes—
The tomato field trial was planned as a one source dripping irrigation (OSDI) system similar to a standard farmer field. Since water deficiency is applied in a relatively uniform manner, it allows measuring the effect of drought on small size populations of plants. The OSDI method was developed on the basis of the line source sprinklers irrigation system (Hanks et al. 1976 Soil Sci. Soc Am. J. 40 p. 426-429) with some significant modifications. Instead of sprinkler irrigation, dripping irrigation was used. In order to create a uniform and deep wet layer (at least 60 cm depth), and not the onion shape layer that is typically created by dripping irrigation, a low pressure compensating dripping irrigation system was used. This system enables to supply small amounts of water in a relatively long time frame. The drought stress field trial was performed in light soil, in an open field (net-house) near Rehovot, Israel. Between 4 to 5 events are been evaluated for each gene and the null segregating populations are used as negative controls. During the first three weeks all plants were grown in a nursery under normal irrigation conditions. After this period, plants were transplanted according to commercial growth protocol, maintaining a 30 cm distance between plants reaching a total density of 2,600 plants per 1000 sq. m (the recommended density in commercial growth). Each plant was transplanted near a water dripper and further subjected to two different treatments:

Optimal (100%):

Optimal irrigation conditions (100%). Irrigation was applied every 2 days as a standard recommended water supply. Standard recommended water supply is the amount applied by local commercial growers according to standard protocols.

Severe Stress (50%):

50% of the optimal amount of water irrigation was applied once a day (at same time as regular irrigation is applied)

All fertilizers were applied according to local standard protocols. Nitrogen was equally applied, as recommended, to all the treatments through the irrigation system. Each row, 193 cm wide, contained two dripping irrigation lines creating coverage of six drippers per 1 sq. m. The irrigation control was performed separately for each treatment. The experiment was structured in a four randomized block design, eight plants per plot. The different water regimes were initiated only four weeks three transplantation, when plants initiated the flowering stage. Water availability in the soil was recorded using tensiometers (used to determine matric water potential $\Psi m$ which allows to evaluate the stress severeness).

Assay 2—Tomato Salt Bath Experiment—

Transgenic tomato seeds are sown in trays containing growth denitrified media. Seedlings are germinated under nursery conditions. The experimental model used was 3 blocks random distributed, where 10 plants per events were sown in each block. At the stage of first true leaf, trays are transferred to different "tanks" containing growth solution of 300 mM NaCl. For normal treatment, a full Hoagland solution was applied. 5 events for each gene are evaluated while null segregating populations are used as negative controls. The experiment is performed for a period of 8 weeks, where parameters such as chlorophyll content (measured as SPAD units), plant biomass (FW and DW) are measured.

Although the invention has been described in conjunction with specific embodiments thereof, it is evident that many alternatives, modifications and variations will be apparent to those skilled in the art. Accordingly, it is intended to embrace all such alternatives, modifications and variations that fall within the spirit and broad scope of the appended claims.

All publications, patents and patent applications mentioned in this specification are herein incorporated in their entirety by reference into the specification, to the same extent as if each individual publication, patent or patent application was specifically and individually indicated to be incorporated herein by reference. In addition, citation or identification of any reference in this application shall not be construed as an admission that such reference is available as prior art to the present invention. To the extent that section headings are used, they should not be construed as necessarily limiting.

REFERENCES CITED

Additional References are Cited Hereinabove

1. World Wide Web (dot) fao (dot) org/ag/agl/agll/spush/degrad (dot) htm.
2. World Wide Web (dot) fao (dot) org/ag/agl/aglw/water-management/introduc (dot) stm.
3. McCue K F, Hanson A D (1990). Drought and salt tolerance: towards understanding and application. Trends Biotechnol 8: 358-362.
4. Flowers T J, Yeo Ar (1995). Breeding for salinity resistance in crop plants: where next? Aust J Plant Physiol 22:875-884.
5. Nguyen B D, Brar D S, Bui B C, Nguyen T V, Pham L N, Nguyen H T (2003). Identification and mapping of the QTL for aluminum tolerance introgressed from the new source, ORYZA RUFIPOGON tariff., into indica rice (*Oryza sativa* L.). Theor Appl Genet. 106:583-93.
6. Sanchez A C, Subudhi P K, Rosenow D T, Nguyen H T (2002). Mapping QTLs associated with drought resistance in sorghum (Sorghum bicolor L. Moench). Plant Mol Biol. 48:713-26.
7. Quesada V, Garcia-Martinez S, Piqueras P, Ponce M R, Micol J L (2002). Genetic architecture of NaCl tolerance in *Arabidopsis*. Plant Physiol. 130:951-963.
8. Apse M P, Blumwald E (2002). Engineering salt tolerance in plants. Curr Opin Biotechnol. 13:146-150.
9. Rontein D, Basset G, Hanson A D (2002). Metabolic engineering of osmoprotectant accumulation in plants. Metab Eng 4:49-56
10. Clough S J, Bent A F (1998). Floral dip: a simplified method for *Agrobacterium*-mediated transformation of *Arabidopsis thaliana*. Plant J 16:735-43.
11. Desfeux C, Clough S J, Bent A F (2000). Female reproductive tissues are the primary target of *Agrobacterium*-mediated transformation by the *Arabidopsis* floral-dip method. Plant Physiol 123:895-904.

SEQUENCE LISTING (1668 sequences)

SEQ ID NO: 1 - DNA, 1255 bp, Oryza sativa
aatccccaccattattgttattgttagtctcgtgcgtcccttatatagaacctgaaccgccggacggaggaggaagacaactcagagacagacaaggacgagcaacccgcaaccgcgaccagaggagaagactcgatcgaatcgaatcgaagcgggaggatttcgggggtccgtgactccgttcggagaaaaggattcagcttgtgggcagaagaagaagaagaagatggcttccgcgaaatccggggagagggggagcagcagcttcgccatggcctgcagcctgctcagccgctacgtcaggcagaacggcgcagccgccggcgagctcggcctcggcatcagaggtgaagccgatgcgaacaaggggaaggagaccatggagctgttcccccagaattccgggttcggctctgaagctgctgccgtgaaggagaccccggatgcgagggagcaagagaagcgccaattaaccatcttctacggtgggaaggtcctggtgtttgatgacttcccagctgagaaggccaaggacctgatgcagatggccagcaagagttcctccacagcgcagaactgtgtccttcttccatcttccgctactgcaaccgttgccgacaacactaaggtgtctgctgtaccagccccagcaagtgcacttcctgttgctcaggccaatgccccgaaacctgttcgtccaaatgctgctgatctgcctcaggctaggaaggcgtcgcttcaccggttcctcgagaaaagaaaggatcgccttcaggctaaagcaccctaccagggttccccttcagatgcttctccggtcaagaaggagctgcaggagagtcagccatggcttgggttaggacctcaggttgccgctcccgacctgagcttgcggcaggaatcgagccaatgaatcaatgctcaattctgagatgcccctctcatcagatgattcagtcatagaggttatcacaactcttgaattgggtgttttgtgttaggagatgatccgatgacaaggcgatgttcttctgatatatatactaggattgaatgtaaagaaagtagctgatgattatgaccagtaatctgaatcaaattgctatgatagaaagcagaagattctgtaatcagtacaacccaagaaacctcatttgtaccaattcaatatcgttttgctttggcattgccatgtagaagcaaagcaaatgtactgctaatatatacacatcacaagattgattgttattcactt

SEQ ID NO: 2 - DNA, 1276 bp, Oryza sativa
aatccccaccattattgttattgttagtctcgtgcgtcccttatatagaacctgaaccgccggacggaggaggaagacaactcagagacagacaaggacgagcaacccgcaaccgcgaccagaggagaagactcgatcgaatcgaatcgaagcgggaggatttcgggggtccgtgactccgttcggagaaaaggattcagcttgtgggcagaagaagaagaagaagatggcttccgcgaaatccggggagagggggagcagcagcttcgccatggcctgcagcctgctcagccgctacgtcaggcagaacggcgcagccgccggcgagctcggcctcggcatcagaggtgaagccgatgcgaacaaggggaaggagaccatggagctgttcccccagaattccgggttcggctctgaagctgctgccgtgaaggagaccccggatgcgagggagcaagagaagcgccaattaaccatcttctacggtgggaaggtcctggtgtttgatgacttcccagctgagaaggccaaggacctgatgcagatggccagcaagagttcctccacagcgcagaactgtgtccttcttccatcttccgctactgcaaccgttgccgacaacactaaggtgtctgctgtaccagccccagcaagtgcacttcctgttgctcaggccaatgccccgaaacctgttcgtccaaatgctgctgatctgcctcaggctaggaaggcgtcgcttcaccggttcctcgagaaaagaaaggatcgccttcaggctaaagcaccctaccagggttccccttcagatgcttctccggtcaagaaggagctgcaggagagtcagccatggcttgggttaggacctcaggttgccgctcccgacctgagcttgcggcaggaatcgagccaatgaatcaatgctcaattctgagatgcccctctcatcagatgattcagtcatagaggttatcacaactcttgaattgggtgttttgtgttaggagatgatccgatgacaaggcgatgttcttctgatatatatactaggattgaatgtaaagaaagtagctgatgattatgaccagtaatctgaatcaaattgctatgatagaaagcagaagattctgtaatcagtacaacccaagaaacctcatttgtaccaattcaatatcgttttgctttggcattgccatgtagaagcaaagcaaatgtactgctaatatatacacatcacaagattgattgttattcacttacgcctgtttccccccccccc

SEQ ID NO: 3 - DNA, 149 bp, Oryza sativa
aatgatccttcaggcagttaaagggagatgatgagtggtaacatctcgctaattaatgttgcgagaggggtgtctgccccaaccaagcctgttacgacaacagggcactccaatattttaccatctgatcccgaatctaagttttaata

SEQ ID NO: 4 - DNA, 144 bp, Oryza sativa
atgatccttcaggcagttaaagggagatgatgagtggtaacatctcgctaattaatgttgcgagaggggtgtctgccccaaccaagcctgttacgacaacagggcactccaatattttaccatctgatcccgaatctaagtttt

SEQ ID NO: 5 - DNA, 725 bp, Oryza sativa
aagcacagcagcaaaactaaactgatcatacacacaaattaagttgtgatcatccgagcaaaagcaaagcaagagaacggtagctagctagttgacacaatgagggcgggcaggttggtgatcctcgtggcggtggcggtggtggtggtggtcgccggcggcggggcggcggagggcgccggcgagtgcgggagggcgtccgccgaccgggtggcgctgcggctggcgccgtgcgtgtcggcggcggacgacccgcagtcggcgccgtcgagcagctgctgctcggcggtgcacaccatcgggcagagccccagctgcctgtgcgccgtgatgctgtccaacacggccagggtcgccgggatcaagccggaggtcgccatcaccatccccaagcgctgcaacatggccgaccgccccgtcggctacaagtgcggagattacacgctgccttgacccttgaggccttgagggggactgtggcacttatcgatatcaagacgtacggatgccgtgggagcttaggctttgtgtcggaataagcgagagtccttcatgttcggggctctgccacttatatggactatgcacgtggtggttgtgaaaatatgtatcctgtgtttcgtctgagtaaactgttaaatataataagaatatacaaaagcttgcttgacaaattaatccgggacgtaaataaattgaccatgcaattaagtgcgtgcgtatat

SEQ ID NO: 6 - DNA, 676 bp, Oryza sativa
aagcacagcagcaaaactaaactgatcatacacacaaattaagttgtgatcatccgagcaaaagcaaagcaagagaacggtagctagctagttgacacaatgagggcgggcaggttggtgatcctcgtggcggtggcggtggtggtggtggtcgccggcggcggggcggcggagggcgccggcgagtgcgggagggcgtccgccgaccgggtggcgctgcggctggcgccgtgcgtgtcggcggcggacgacccgcagtcggcgccgtcgagcagctgctgctcggcggtgcacaccatcgggcagagccccagctgcctgtgcgccgtgatgctgtccaacacggccagggtcgccgggatcaagccggaggtcgccatcaccatccccaagcgctgcaacatggccgaccgccccgtcggctacaagtgcggagattacacgctgccttgacccttgaggccttgagggggactgtggcacttatcgatatcaagacgtacggatgccgtgggagcttaggctttgtgtcggaataagcgagagtccttcatgttcggggctctgccacttatatggactatgcacgtggtggttgtgaaaatatgtatcctgtgtttcgtctgagtaaactgttaaatataataagaatatacaaaagcttgcttgacaaatt

SEQ ID NO: 7 - DNA, 1960 bp, Oryza sativa
tgtggggactcttcttcgtcctcaccaaacaaaccctagcctcttcataatcggagaaaaagaaagagaaaaccctaaggctctctcccctccggcggcgacaggacgggttctcgatcagggttgccagcgaacacgtctacgatggcggatgaaagcgagcggagcggtatggtaatcgacgacgtcggcggcggactgaatcttccaataattgttgcaggcaagcgtaagcgggagctcacatgggaagagaaggcgttgacagttcttgatattgtcgggtcccaacagcaccccgcatgccaacctgccgagcgtgattgcagcctcatagactcggagaaagattactcatctatggccggctgccaggccggagaacacgctagtatatttggcattgacaagaatggggatgattctgatgaaccgtgtgctaaggatgatgccaagcaaagtgatgtggctcctctgaaggaggaggagaattgggagctggacagtgaaccagagctcacatgggatgagaaggtggttgaagttctaaacatagttcgacgccgagagatcaccgaatataaccccaagcagttttgctcaattcctactcgattttgtgcctacaacatagccttctttgacctggacaaagagtcaaagcttgcacgtggaccacctatcaagtcactagctttccccgactactggtgggagatggactctgtcaatgtgattgcaatcaaggtggccgagtctgatgtgggttaccctatcagggtatttggcactgtgctggccagggatgagtacgatttcaggtgtgtctatttgttcaggcgtgacaggaacaatccacagatcatcacctcgccggaggacacactaactctgacaggacctaatcgagcgctgggtgcaatagacaaaatgtatttcgagttcaatttgaagattagagacggtgatgtcgacaaagatttctgcaaaggtgtgcgagaacacaatgccatctgctatacaaagcagccgatgactttatcgctagagagctgcctgagtagaattgattttgtgtatagtcctgttcaattagctgtggaagcttctgttgcagtcaaaattaagggggttgtatccaagtttttcactggcaaagtgactgcttggactactggagatgatcagaacaaaatcatcctgtatgacagtgaagtggaaggcaggaacagagttcttggagctgatggatcagtcgatctgactcgctgtttcgtagccgtcaatttggatgatgaactggtgctcaatgtctgtgtttctgaaggagctggctcaatctttgagctcgttcttggacacaatgatgaagaatgtgtccttgagcaaggtccctatgaactgcaggtgaatgttgtttggacagctgccttgaagcatcgacagcgcagaaaattgtttgagcgtatcggtgacttccgcgtgttaaggtgatatgtagtatgaagatttatatgggggaagctgttacatctcaagcagttctttcttgttatatagattataatttttttgttcagctgagttgaactcgtgcttaactgaaaatctgcctgcaagacttatttagttatatgtactggtagactggtaatctataagattactgatgtctagtagggagtatggatctgtctggtagtctgtataaccttttctgaacctaccaaagtttattttgcgttcttggagaagtgtcttgtctgtcattgttacttactgggttgtgagcatcggattgaggtagtttgtagaggtttgagcgccatgtgtgctctactgttgccatttgctgttgagagatgctgagaacctgacgtttatggctatatatatgttgatgttttgtaagttaatgctactactattgctagaactaagtaagttgattcattttatg

SEQ ID NO: 8 - DNA, 1959 bp, Oryza sativa
gtggggactcttcttcgtcctcaccaaacaaaccctagcctcttcataatcggagaaaaagaaagagaaaaccctaaggctctctcccctccggcggcgacaggacgggttctcgatcagggttgccagcgaacacgtctacgatggcggatgaaagcgagcggagcggtatggtaatcgacgacgtcggcggcggactgaatcttccaataattgttgcaggcaagcgtaagcgggagctcacatgggaagagaaggcgttgacagttcttgatattgtcgggtcccaacagcaccccgcatgccaacctgccgagcgtgattgcagcctcatagactcggagaaagattactcatctatggccggctgccaggccggagaacacgctagtatatttggcattgacaagaatggggatgattctgatgaaccgtgtgctaaggatgatgccaagcaaagtgatgtggctcctctgaaggaggaggagaattgggagctggacagtgaaccagagctcacatgggatgagaaggtggttgaagttctaaacatagttcgacgccgagagatcaccgaatataaccccaagcagttttgctcaattcctactcgattttgtgcctacaacatagccttctttgacctggacaaagagtcaaagcttgcacgtggaccacctatcaagtcactagctttccccgactactggtgggagatggactctgtcaatgtgattgcaatcaaggtggccgagtctgatgtgggttaccctatcagggtatttggcactgtgctggccagggatgagtacgatttcaggtgtgtctatttgttcaggcgtgacaggaacaatccacagatcatcacctcgccggaggacacactaactctgacaggacctaatcgagcgctgggtgcaatagacaaaatgtatttcgagttcaatttgaagattagagacggtgatgtcgacaaagatttctgcaaaggtgtgcgagaacacaatgccatctgctatacaaagcagccgatgactttatcgctagagagctgcctgagtagaattgattttgtgtatagtcctgttcaattagctgtggaagcttctgttgcagtcaaaattaagggggttgtatccaagtttttcactggcaaagtgactgcttggactactggagatgatcagaacaaaatcatcctgtatgacagtgaagtggaaggcaggaacagagttcttggagctgatggatcagtcgatctgactcgctgtttcgtagccgtcaatttggatgatgaactggtgctcaatgtctgtgtttctgaaggagctggctcaatctttgagctcgttcttggacacaatgatgaagaatgtgtccttgagcaaggtccctatgaactgcaggtgaatgttgtttggacagctgccttgaagcatcgacagcgcagaaaattgtttgagcgtatcggtgacttccgcgtgttaaggtgatatgtagtatgaagatttatatgggggaagctgttacatctcaagcagttctttcttgttatatagattataatttttttgttcagctgagttgaactcgtgcttaactgaaaatctgcctgcaagacttatttagttatatgtactggtagactggtaatctataagattactgatgtctagtagggagtatggatctgtctggtagtctgtataaccttttctgaacctaccaaagtttattttgcgttcttggagaagtgtcttgtctgtcattgttacttactgggttgtgagcatcggattgaggtagtttgtagaggtttgagcgccatgtgtgctctactgttgccatttgctgttgagagatgctgagaacctgacgtttatggctatatatatgttgatgttttgtaagttaatgctactactattgctagaactaagtaagttgattcattttatg

SEQ ID NO: 9 - DNA, 2665 bp, Oryza sativa
gtgggtgggttttcttctccaacgaaactctatcccctctcttcttctctccgctccgcgtgtccactcctctcccaatctgtgttggctgccatcctatgcacctacctacacctccctgccgaccaacaaccctgagcaggcgagctcccccacggccgctgagggccacgcggcgacgcctcgtgcccggtggccgtgcactgcagcgctagtgcggttttgcctccccagcgcctacgtctacaccgcgccgcgcaccccacggccctgccgccatgctcctgcatctccgcctcccttcctagttcctacatgtttcactacttagctgtgttgccaaatcacactcgggcctaattccatttcagcactatactacattactaatttgatatatatgttctgtatgcaggttttggatcagatgcagtgatgaatcctaggtgacagagcctattaggctagaacagaccaatatggcaaggagtagaaggcggtgcattgttcaaagccatgaggaatatttgtcagaggaacacattgcagaagaaaatgcccctaaacagcttgccacaccatctgaacaagaaacaatatgtagtgatgttcaagagggtaatgaagatactaatgacgatgttggagaagccaatgaagatactgatgacgatgctagtatgaatgctggagaaggcaatgaagaatctgatgatgatgttgaaattaatgttcgagatgaaaatggaacaattgaaacacgtgggaagacaaaactgaaagatatttggaaccttccgaaaaggcttaggattgtggttcagtgcaatgatctcaaccaggcagtaggagatgaagctggaattttgtctaaatttcttggaatggtagctaggaatggtactttgtgtagcttaagctacacagactggagatttctaataggaaagagagagagaaaaacaaaatccctagatgagtttctttgttggtatccagatgagattcctttatgctcctcggatggaagaattcatattaaaaacaattagagagagatggaggggacataaagcaaaactaaaagaaaagtattttgatgtgaataagagcaaagaagctaattgcaacaatgtcccagctgatgtgcttcctgaccagtggattgctcttatcaatcattggatgagcgagaaatcgaagaaaataagcaagcagaacaaggaaaattgtcgaaagaagaaggcattacacacagcagggacaaatagttttgctcgtacaagagaagagatgagacaaaaagatcctgcaaagaatcctcacagagctattgtgtacatccaaacacacaagcgcaaaactggcaagaatctaaatgggcatgtggataatttgaagaaacttgtagttgaacaaccagctttagcagacactagtgaaggaaggactgcttggaaaggagatgcattgaaccaaatacttggagatgacaagcctgggcatgtgcatggtcttggactagttccaaagcctaaacaagttctcgatgtgccaaattcctgacgcttaaagaatataaatgttactagactggatgataactggagtgaagatgttgtggctgctagactgcagttggaaaagatcgaaaatcatgtccagaatcatgatgctgagcttttggaattgaaagcgaagacaaacaagttggaaaaagaacaaatgaatcagggaggtttagatcgagtatctacaaacaaagaagctagtgttgatggccctatttcgaaaaggaggagagtgtattctgaccatcccttgcaagaaatttgtattgctgaggaggaaaacgatatggttcaggaggaaaacaatatgatgaatatacagagccatgttccaaatgaggatttgcaaccaaaaaccaagcaatgtgttgaagacaagaacaaacaaaattgggaacaacatgactatgggaaacaaaggaaggttatttctgcacagaaaaaaaaaactaacaaggaaaaccatgtgatgaatgcacgaaaagttgttgaagcatccaagaataaagaaagagaaaaaaaatgctcagagccatgttagactaggccaaaaccaaccaactgctgctcctaagaaaagacagtgcagcacaacaaactttatcgctgacaattcaatggaggacacaaatatccatgttcagaacaaggttttgcaactaccaaccaagcaatctactatatataagagcaatcaaacttatggccaaaatcaccttgagaaacagaggaagattatttgtgtgaagaataaaggaaacatgaaccagaatgatcacatgcaacaagggaagaataattctaatgcttataaggttgacaagataaatggatcatgatctggggcaatatggttactgcaaggtggacaactgtcatctaaagatcccttgtgaatatgatgatgactgtaatatggaagatggtggcaatgatagtggcaacttcagatgcatgtttttttttctatagtttagtttacatttgtgcatgatgttctgaacaaaatttaatgtcatgacttatgaggatgattttccatgtaatacaaaaaattctctttaattacaattagttttatgaatgacttggtt

SEQ ID NO: 10 - DNA, 1757 bp, Arabidopsis thaliana
gtttcttcgctgaaccacacaaagcttgttcttctccttccttctccaatttcgtaagctcaaagatttcgatttcgattttgattattgccaaaggtttaaagatggatattttcgacaactctgatcttgaataccttgttgatgaatttcacgctgatttcgatgatgatgagccctttggagaggttgatgtcaccagtgagtctgattccgatttcatggactccgattttgatttcgagctgagtgagagtaagacgaacaatgaaacatcagcgttagaagctaggaatggaaaagatattcaagggattccatgggagagcttgaattacacgagggatagataccgtgagaatagattgctgcactataaaaactttgagagtctgtttcgatccagagaagagcttgataaggaatgcttgcaagtagagaaaggaaagaacttttatgactttcagttcaatacaaggcttgtcaagtccacaatagcgcattttcagctgaggaacttggtatgggcaacatcaaagcacgatgtgtatttcatgaacaactactctctcatgcactggtcatctttgttgcaaaggggcaaagaagtacttaatgtggcaaagcccattgttccttcaatgaagcagcatggatcgttgtcacagtctgtatcaagagtccagataagcaccatggcagttaaagacgatttgatagttgcgggagggttccaaggagagcttatctgtaagaaaatcaacgaacctgaggttgctttctgcactaaactaacatcagctgataacgacatcaccaattcggttgacatctacaacgcacctagtggctcgttaagggttatgaccgcgaacaatgactgtactgtccggctatttgatgccacaaactttgccttgctcaacagatttgcctttcactggtctgtaaataacatctccaccagtccagatggtaagctagtggctgttctaggagacagtcctgagtgcttactagcagataccggatctggaaaagtgatccacggactcgaaggccatctcgactactcgttttcatcagcatggcacccaaacggtcaaatcttagccacgggtaaccaagacacaacctgtagactatgggacgtaaggaacctgtctcaatcactcaaagtcttgaaaggaaacatgggagctatcagagccttgaggttcacgtctgatggacggttcttagccatggctgagccagcggactttgtacacttgtttgacacggaagctggttacagtcagtgtcaagagattgatctgtttggagaaatagcgggaatctcgtttagccccgacacggaggcactgttcgtgggagtagctgatcgtacgtacggcagcttgttggagtttaacaggaagcgaaaccactcgtatgttgattccatattctgatctgactccaatcgttagaagcaaattaaggagctatatgtatgtgtgagattatggttgtagtggctgttggagggattaaaagtcgttgtttttgtgactttccctttgtcatgtttatgtggttttaggaattccatgtttggtcaactgtagaacatacgtacttatatgagtgctgttaaactttgaagacacaacttgtaggctatggggacgtgaggaacctgttaaaatttgaagcccaactcgatgttcagaagcagcaccaggcctttatttataataaaaatttgtggcttg

SEQ ID NO: 11 - DNA, 2267 bp, Arabidopsis thaliana
aacacattataataaaagaaataaataaatttataaaaaggctcatttctcttcttctttggttcttacatttctctatatcattttttgtccttccattaaaaacggaataaacagaatgaacggtggtgatgtcaccgtcgccggatccgacgatctgaaatctccgctcttaccggtcgtccataatgatgaaccattcgaacgacaaacggtgggacaacaacttcggacaatattcacgcccaaaaactgttacatcgctcttggtcctcttctttgcgccgtcgtgtgtctatgcgtagatctcgggggagatgaaacgacgacggcgaggaacatgctcggtgttttggtgtggatgttcgcgtggtggttgacggaggccgttccgatgccgatcacctccatgacgccgctcttcctcttccctctctttggtatatcggctgcggatgacgtagcaaattcttacatggatgacgtcatctcccttgtactcggcagcttcatacttgctctcgccgtcgaacactacaacatccatcgccggcttgcccttaacataacgttggtgttctgcgtggagccgctaaacgcgccgctacttctgcttggcatctgcgccacaacagcgttcgtaagcatgtggatgcataacgtagcagctgcagtcatgatgatgcctgtcgctacggggatacttcagagactgccctcgtcatcatcgacgacggaagtggtgcatccggccgtggggaagtttagcagggcggtggtgttaggtgtgatatactctgcggcggttggtgggatgagcacactcactggaacaggagtgaatctgattcttgttggaatgtggaaaagctacttccctgaggctgatccgatcagttttagccaatggttcttctttggcttcccattggctttgtgcatattcgtggtgctttggtgtgttctttgtgttatgtattgtcctaaaggagcaggacaagctctctctccttatctccataaatctcatctcaggagagagcttgatttgttagggccaatgaacttcgctgagaagatggtcttagccgtgtttggtgggttggttgtgttgtggatgacaaggaatataactgatgatatccccggctggggtcggatcttcgccggccgagccggggatggaaccgtgagtgtgatgatggcgacattgttgtttatcatcccaagcaatattaaaaaaggagagaagctaatggactggaacaaatgcaagaaactaccatggaacattgtcttgttattgggagctggattcgctatagccgatggagtacgcaccagtggcttagctgaggtcttatccaaaggacttgtcttccttgaaacggctccttactgggccattgctccaacggtttgcctcatcgctgctaccatcacagagttcacttcaaacaacgcaaccactacattgttggttccgttactcatcgaaatcgcaaagaacatggggatccatcctttgctcttgatggttccaggagccattggggctcagttcgctttcttgcttcccacgggaacaccctctaacgtcgttgggttcacgacagggcatatagagatcaaagacatgatcaagacaggcttgcctctcaagatcgctggaaccatctttctctccatcttgatgcccactcttggggcttacgtttttgcatcaatgggaggagtttagttctacaagccaagcacaagaccatgtacacaattgatttattgtactatattgtttactaccgtaatacatatgtagatatatagtcaatggaatgggaaatttagatgaggtcaaaattcacaaaatcggcccatttttgtaacccgcccgattatagtttccggtaccattgctttcttttgtgcttccaacgtaccggtaactttggtccctttttttttttgtttggtgtgtatatgaaaaagggttaatacagatttgtgtgttcttcttcctaacaatagcaactagtggcaaatccagcgcgcggtccaacctggccataccataccacgtcattgtccagcgtgtcttcttctgttttcggttttctacaaacacaaaaagcaaagaaaacaaaacatcaatgcatggtttataacgtcttgctttttaattagtttttgtcctttacactcatttatgttctttctttgtcctttgctatacactacttgtctattgaataatatgcttataatcg

SEQ ID NO: 12 - DNA, 2268 bp, Arabidopsis thaliana
aacacattataataaaagaaataaataaatttataaaaaggctcatttctcttcttctttggttcttacatttctctatatcattttttgtccttccattaaaaacggaataaacagaatgaacggtggtgatgtcaccgtcgccggatccgacgatctgaaatctccgctcttaccggtcgtccataatgatgaaccattcgaacgacaaacggtgggacaacaacttcggacaatattcacgcccaaaaactgttacatcgctcttggtcctcttctttgcgccgtcgtgtgtctatgcgtagatctcgggggagatgaaacgacgacggcgaggaacatgctcggtgttttggtgtggatgttcgcgtggtggttgacggaggccgttccgatgccgatcacctccatgacgccgctcttcctcttccctctctttggtatatcggctgcggatgacgtagcaaattcttacatggatgacgtcatctcccttgtactcggcagcttcatacttgctctcgccgtcgaacactacaacatccatcgccggcttgcccttaacataacgttggtgttctgcgtggagccgctaaacgcgccgctacttctgcttggcatctgcgccacaacagcgttcgtaagcatgtggatgcataacgtagcagctgcagtcatgatgatgcctgtcgctacggggatacttcagagactgccctcgtcatcatcgacgacggaagtggtgcatccggccgtggggaagtttagcagggcggtggtgttaggtgtgatatactctgcggcggttggtgggatgagcacactcactggaacaggagtgaatctgattcttgttggaatgtggaaaagctacttccctgaggctgatccgatcagttttagccaatggttcttctttggcttcccattggctttgtgcatattcgtggtgctttggtgtgttctttgtgttatgtattgtcctaaaggagcaggacaagctctctctccttatctccataaatctcatctcaggagagagcttgatttgttagggccaatgaacttcgctgagaagatggtcttagccgtgtttggtgggttggttgtgttgtggatgacaaggaatataactgatgatatccccggctggggtcggatcttcgccggccgagccggggatggaaccgtgagtgtgatgatggcgacattgttgtttatcatcccaagcaatattaaaaaaggagagaagctaatggactggaacaaatgcaagaaactaccatggaacattgtcttgttattgggagctggattcgctatagccgatggagtacgcaccagtggcttagctgaggtcttatccaaaggacttgtcttccttgaaacggctccttactgggccattgctccaacggtttgcctcatcgctgctaccatcacagagttcacttcaaacaacgcaaccactacattgttggttccgttactcatcgaaatcgcaaagaacatggggatccatcctttgctcttgatggttccaggagccattggggctcagttcgctttcttgcttcccacgggaacaccctctaacgtcgttgggttcacgacagggcatatagagatcaaagacatgatcaagacaggcttgcctctcaagatcgctggaaccatctttctctccatcttgatgcccactcttggggcttacgtttttgcatcaatgggaggagtttagttctacaagccaagcacaagaccatgtacacaattgatttattgtactatattgtttactaccgtaatacatatgtagatatatagtcaatggaatgggaaatttagatgaggtcaaaattcacaaaatcggcccatttttgtaacccgcccgattatagtttccggtaccattgctttcttttgtgcttccaacgtaccggtaactttggtccctttttttttttgtttggtgtgtatatgaaaaagggttaatacagatttgtgtgttcttcttcctaacaatagcaactagtggcaaatccagcgcgcggtccaacctggccataccataccacgtcattgtccagcgtgtcttcttctgttttcggttttctacaaacacaaaaagcaaagaaaacaaaacatcaatgcatggtttataacgtcttgctttttaattagtttttgtcctttacactcatttatgttctttctttgtcctttgctatacactacttgtctattgaataatatgcttataatcgt

SEQ ID NO: 13 - DNA, 1209 bp, Oryza sativa
cgccacgttcctcctcacctttcacccacccaccaccacaccacagctacttaccttgcccgccacacactacaccagcttagctagctagctcgctcgctacctcctccttggttcattcccttcacggctaagttcccagatagccagcagcgatcgtagtgtgtcgcaacatggcgccgcggctgttgtcgtgttttggcaggggcagcgcgacggcgtcggcgccggatcagccggaggaggcggcggcggcggccgcgccggggccggtgctgctggagctgttctgctcgcaggggtgcggggcgtcgccggaggcggacgcggtggcggcgcggatggtgcacgaggaccagcagcgggcggcggcgggcgagggaggcggcggggagcgcggcgtggtggtgctgggcttccacgtcgactactgggactaccgcgggtggaaggacccgttcgcgtccagcgcgtggacggtgcggcagaaggcgtacgtggaggcgctccggctcgacactctgttcacgccgcaggccgtcgtgcagggccgcgcccactgcgtcggcaccgagcaggacgccctcgcccaggccgtccgcgacacgccccgctaccccgcccccgccatgaaggtgacgttccagcggccgaacccgagcacgctgcaggcgtcgttcacggggacgctgcggagccggatggagggcggcgggagcgtgctggtggcgctgtacgagagcgggctggtcacggactgcgggcgcggcgagaacaaggggaagtcgctgctcaacgaccacgtggtgcggcggctggagaaggtggccgccgtgcgcgacggcgcgtcggcgaagaagtccgtgtccgggtccgtgcagttcccgctctgggacggcttccgcgcctcccgctgcggcctcgtcctcttcgtccagaacgccgcgctgcaggtgctcggcgtccagcacttcgacctgcccgacaacgtgtgactactcgcggtcggtcggtcgaggcttgcgcctgcgtgtgtagacgtgtgccgtgtaatgtactactagtaaatattctttgtagagtacacgtttgattattgatcgacgcgtttgtattgttgttgatttgttgggggtacgagactagacgagagtggggagatgggtaattggagacattattaattcagacattgcagcagccttgcag

SEQ ID NO: 14 - DNA, 1192 bp, Oryza sativa
cctttcacccacccaccaccacaccacagctacttaccttgcccgccacacactacaccagcttagctagctagctcgctcgctacctcctccttggttcattcccttcacggctaagttcccagatagccagcagcgatcgtagtgtgtcgcaacatggcgccgcggctgttgtcgtgttttggcaggggcagcgcgacggcgtcggcgccggatcagccggaggaggcggcggcggcggccgcgccggggccggtgctgctggagctgttctgctcgcaggggtgcggggcgtcgccggaggcggacgcggtggcggcgcggatggtgcacgaggaccagcagcgggcggcggcgggcgagggaggcggcggggagcgcggcgtggtggtgctgggcttccacgtcgactactgggactaccgcgggtggaaggacccgttcgcgtccagcgcgtggacggtgcggcagaaggcgtacgtggaggcgctccggctcgacactctgttcacgccgcaggccgtcgtgcagggccgcgcccactgcgtcggcaccgagcaggacgccctcgcccaggccgtccgcgacgcgccccgctaccccgcccccgccatgaaggtgacgttccagcggccgaacccgagcacgctgcaggcgtcgttcacggggacgctgcggagccggatggagggcggcgggagcgtgctggtggcgctgtacgagagcgggctggtgacggactgcgggcgcggcgagaacaaggggaagtcgctgctcaacgaccacgtggtgcggcggctggagaaggtggccgccgtgcgcgacggcgcgtcggcgaagaagtccgtgtccgggtccgtgcagttcccgctctgggacggcttccgcgcctcccgctgcggcctcgtcctcttcgtccagaacgccgcgctgcaggtgctcggcgtccagcacttcgacctgcccgacaacgtgtgactactcgcggtcggtcggtcgaggcttgcgcctgcgtgtgtagacgtgtgccgtgtaatgtactactagtaaatattctttgtagagtacacgtttgattattgatcgacgcgtttgtattgttgttgatttgttgggggtacgagactagacgagagtggggagatgggtaattggagacattattaattcagacattgcagcagccttgcag

SEQ ID NO: 15 - DNA, 1719 bp, Arabidopsis thaliana
tataaaccaactacttactatattgtccaaaagatcgacgaacataaaaacaaaaacatataatttgggtttttagagttcgaaacttgaaatctttttttttttggttgctgaggaatcgaagtagaagagtataaatgggtgttagagagaaagatccgttagcccagttgagtttgccaccaggttttagattttatccgacagatgaagagcttcttgttcagtatctatgtcggaaagttgcaggctatcatttctctctccaggtcatcggagacatcgatctctacaagttcgatccttgggatttgccaagtaaggctttgtttggagagaaggaatggtatttctttagcccaagagatcggaaatatccgaacgggtcaagacccaatagagtagccgggtcgggttattggaaagcaacgggtactgacaaaattatcacggcggatggtcgtcgtgtcgggattaaaaaagctctggtcttttacgccggaaaagctcccaaaggcactaaaaccaactggattatgcacgagtatcgcttaatagaacattctcgtagccatggaagctccaagttggatgattgggtgttgtgtcgaatttacaagaaaacatctggatctcagagacaagctgttactcctgttcaagcttgtcgtgaagagcatagcacgaatgggtcgtcatcgtcttcttcatcacagcttgacgacgttcttgattcgttcccggagataaaagaccagtcttttaatcttcctcggatgaattcgctcaggacgattcttaacgggaactttgattgggctagcttggcaggtcttaatccaattccagagctagctccgaccaatggattaccgagttacggtggttacgatgcgtttcgagcggcggaaggtgaggcggagagtgggcatgtgaatcggcagcagaactcgagcgggttgactcagagtttcgggtacagctcgagtgggtttggtgtttcgggtcaaacattcgagtttaggcaatgagagagatgtgaagttactgatgggtgaaaaaagtaaaaaaaaaacttggagatagtagagtggcaattgatgtaaataatagggatttatatggggcttttaccgattcggtgaggcttaggattccacaaaggaaaaaggctcgactggggactagtttgatccaacttgacggcccacaaatgtgtaatgtttctcaacggagagaaaaataaatggttaccaatatttttacaccggttatgtgttgataccatttgcacaaaacggtttaagttctgaattgaataacttaacacccaaaatttggtaaaaagcttaatacaaaaagttcaaaggcattttcgcttactgcgacactcggagttgcagagtactctacgtaacagactctgttcatagagtttgcggcaccggtggtgggacattcttgcggacacagtatgtacttttggaagcatcgttcctaagggttgctgcagtaaactccttgtgacttggctcgcaagaaacataacatggccgcaagaaaaaacagcattaacgaagaggtgtttgagatcttcatgtctagtttattcttcctgttttattatgtgtcgactggtgtcaaaagaaacgtgttgattgtgaatttgtagacgccactctgtaaatttatttaaaataaactattttacttcacgtc

SEQ ID NO: 16 - DNA, 862 bp, Arabidopsis thaliana
aactcacagttccaaacacacaaaaaacacaagatctaaaaaaaaaagcttttatcatttagaaaaatttggtttcgaatttcttcgaagagtgaaaatggcgtctcatcaagaacagagttacaaagctggtgaaaccagaggcaaggctcaggagaaaactggggaagctatgggaacgatgggggacaaaacacaagcagctaaggacaaaactcaagagacagcccagtcagcccaacaaaaggctcatgaaacagctcagtcagctaaagacaagacgtctcaagctgcacaaacgactcaagagagagctcaagagtccaaagacaagacaggaagctacatgtcggaaactggagaagcaatcaagaacaaggcacacgatgcagctgaatataccaaagagactgcagaagcaggtaaggagaagaccagtgggatcttgggccagaccggtgagcaggtgaaacagatggctatgggagctactgatgcggtgaagcacactttagggcttcgcactgatgaaggaaacaaagaacatgtttcttcagctccaagtactactactacgaccactactcgtgagacacagaggaagtgaagaggataaatatttgtttcgtgttcgtggttttcatgtttgtttgctttgattagtgtttgttgcgttcgtgaggttatgccgatccttgttgttgtttattgggtttgaatgtacttctacgtattatcatgtaatggttttcttttataaattggacactagttatttcgggtgattagtacggaaattacataattggtattttataaagttttcgttttaaactttgcctaatacgaagacatttacatc

SEQ ID NO: 17 - DNA, 2134 bp, Arabidopsis thaliana
ggtggttcggccatatgtcatcgttctctctataaactttatggaactttgttctgattttctcagagacacgaaaagaaagaaaacaacactagaacaaagagggtttgattgattcacttgaaaaagagaaaacacagctttggaaaatggagtcacagttgacacgtccttatggtcatgagcaagcagaagaaccaatcagaattcaccatccagaagaagaagagcatcatgagaagggagcatccaaagtgttgaagaaagtaaaagaaaaggctaagaaaatcaagaacagtctcactaaacatggaaatggtcatgatcacgatgtggaagatgatgatgatgagtatgacgagcaagacccagaagttcacggcgcaccagtgtatgaatcctctgccgtgagaggtggtgtaacgggtaaacctaagtctcttagtcatgccggagaaactaatgttccggcatcggaggagattgttcctccagggacaaaagtttttcctgtcgtgtcttctgaccacaccaaacccattgagcctgtatcattacaagatacctcttacggacatgaggcactggctgatcctgtaagaacgacggaaacatcggactgggaagcgaaaagagaggcaccgactcattatcctctcggagtgtcagaattttcagacagaggagagagcagagaggctcatcaagagccattgaacactcctgtgtctctgctttcagcaacagaggacgtgactaggacgtttgctcctggtggtgaagatgactatctcggtggtcaacggaaagtcaacgtcgagacgccaaaacgtttggaggaagatccggctgctccaggaggaggatcggattatctcagtggtgtatctaattatcagtccaaagttactgatcccacgcataaaggtggagaagctggagtaccagagattgctgagtctcttggtagaatgaaagtgactgatgagtctcctgatcagaaatcaagacaaggacgcgaagaagactttccgacgagaagccatgagtttgatctgaagaaggaatctgatatcaacaagaattctccggcaagatttggaggggaatcaaaagctgggatggaggaagattttccgacaagaggtgatgtgaaagtagagagtggattgggaagagacttaccgacgggaactcatgatcagttctcaccagaactatctcgtcccaaagagagagatgattctgaggaaaccaaagatgagtcgacacatgagacaaaaccaagcacctacacagagcagttagcttcagctacatcagccataactaacaaagctatagccgcaaagaacgtcgttgcctcaaagctaggttacaccggagagaatggcggcgggcaaagcgagagccctgtaaaagatgaaactccgagatctgttactgcttacgggcagaaagtggcgggaactgttgctgagaagttgactccggtttacgaaaaagtcaaagaaacaggatcaacggtgatgacaaagctacctctctccggaggtggaagtggagtgaaggagacgcaacaaggggaagagaaaggtgtgacggctaaaaattatatatcagagaagctgaaacctggagaagaggacaaagctttatcggaaatgatagctgagaaacttcattttggaggaggaggagagaagaagacaacggctacaaaggaggtggaagtgacggttgagaagataccttccgaccagatagcggaggggaaaggacatggtgaggcggttgcagaggaaggaaaaggtggagaaggaatggtggggaaagttaaaggagcggtcacttcttggctcggtggtaaaccgaagtcgccacggtccgttgaagagtctccacaatcacttggcaccaccgttgggactatggggttttcggattccggtggaagtgagttgggaggcagtggcggaggtaagggagttcaagattctgggaactgaagatttggggttttgcttttgaatgtttgtgtttttgtatgatgcctctgtttgtgaactttgatgtattttatctttgtgtgaaaaagagattgggttaataaaatatttgcttttttggataa

SEQ ID NO: 18 - DNA, 2134 bp, Arabidopsis thaliana; identical to SEQ ID NO: 17

SEQ ID NO: 19 - DNA, 2354 bp, Arabidopsis thaliana
acaaatatgcaaactagaaaacaatcatcaggaataaagggtttgattacttctattggaaagaaaaaaatctttggaaaatggatcaaacagaggaaccaccactcaacacacaccagcagcacccagaagaagttgaacatcatgagaatggtgcgactaagatgtttaggaaagtaaaggctagagctaagaagttcaagaacagtctcactaaacatggacaaagcaatgagcatgagcaagatcatgatttggttgaagaagatgatgatgatgacgagctagaacctgaagtgatcgatgcaccaggcgtaacaggtaaacctagagaaactaatgttccagcatcggaggaaattattccaccagggacaaaggtgtttcctgtcgtgtcttccgattacaccaaacccactgaatctgtaccagtacaagaggcctcttacggacacgatgcaccggctcattctgtaaggacgacgtttacatcggacaaggaagagaaaagagatgtaccgattcatcatcctctgtccgaattgtcagacagagaagagagtagagagactcatcatgagtcattgaacactccggtctctctgctttctggaacagaggatgtaacgagtacgtttgctccaagtggtgatgatgaatatcttgatggtcaacggaaggtcaacgtcgagaccccgataacgttggaggaagagtcggctgtttcagactatcttagtggtgtatctaattatcagtccaaagttactgatcccaccaaagaagaaactggaggagtaccggagattgctgagtcttttggtaatatggaagtgactgatgagtctcctgatcagaagccaggacaatttgaaagagacttgtcgacgagaagcaaagaattcaaagagtttgatcaggactttgactctgttctcggtaaggattcgccggcgaaatttccaggtgaatcaggagttgttttcccggtgggctttggtgacgagtcaggagctgagctggaaaaagattttccgacgagaagtcatgattttgatatgaagactgaaactggaatggacacgaattctccatcaagaagccatgaatttgatctgaagactgaatctggaaacgacaagaattctccgatgggctttggtagtgaatcaggagctgagctggaaaaagaatttgatcagaagaacgattctggaagaaacgagtattcgccggaatctgacggcggtttaggagctccgttgggaggaaattttccggtgagaagtcatgagttggatctgaagaacgaatctgatatcgacaaggatgtgccgacgggatttgacggagaaccagattttctggcgaagggaagacctggatacggtgaggcatcagaagaggataaatttccggcgagaagtgatgatgtggaagtagagactgagctgggaagagacccaaagacggagactcttgatcaattctcaccggaactttctcatcctaaagaaagagatgagtttaaggagtccagagatgattttgaggagacgagagatgagaaaacagaggagccaaaacagagcacttacacagagaagtttgcttcaatgctaggttactccggagaaattccggtgggagatcaaactcaagtggcgggaactgttgatgagaagttgactccggtcaatgagaaggatcaagaaacagagtctgccgtgacgacgaagttacctatctccggaggtggaagtggagtagaggagcaacgaggggaagataaaagtgtgtcgggtagagattatgtggcggagaaactgacaactgaagaagaagacaaagccttttctgatatggttgccgagaaacttcagattggaggagaagaagagaagaaggaaacgacgacaaaggaagtggagaagatctctaccgagaaggcagcatcggaggagggtgaggcggtggaagaggaagtgaaaggaggaggaggaatggttgggaggattaaaggatggttcggtggtggtgcgactgatgaggtgaagccagaatcgccacattctgttgaagaggctccaaaatcatctggctggtttggtggtggtgcgacggaggaggtgaagccaaaatcgcctcattccgttgaagagtctccacaatcacttggctccactgttgttccggtgcagaaggagctttaagaatatgagaactgagattttcaagtttcactttggatgtttatgtgtgttttgtttgacgtctttgatgtattatggtataattccttgtttgtgtgaaaaaaggacatttggttaataaattgttcggctttggattaa

SEQ ID NO: 20 - DNA, 2354 bp, Arabidopsis thaliana
cacaaatatgcaaactagaaaacaatcatcaggaataaagggtttgattacttctattggaaagaaaaaaatctttggaaaatggatcaaacagaggaaccaccactcaacacacaccagcagcacccagaagaagttgaacatcatgagaatggtgcgactaagatgtttaggaaagtaaaggctagagctaagaagttcaagaacagtctcactaaacatggacaaagcaatgagcatgagcaagatcatgatttggttgaagaagatgatgatgatgacgagctagaacctgaagtgatcgatgcaccaggcgtaacaggtaaacctagagaaactaatgttccagcatcggaggaaattattccaccagggacaaaggtgtttcctgtcgtgtcttccgattacaccaaacccactgaatctgtaccagtacaagaggcctcttacggacacgatgcaccggctcattctgtaaggacgacgtttacatcggacaaggaagagaaaagagatgtaccgattcatcatcctctgtccgaattgtcagacagagaagagagtagagagactcatcatgagtcattgaacactccggtctctctgctttctggaacagaggatgtaacgagtacgtttgctccaagtggtgatgatgaatatcttgatggtcaacggaaggtcaacgtcgagaccccgataacgttggaggaagagtcggctgtttcagactatcttagtggtgtatctaattatcagtccaaagttactgatcccaccaaagaagaaactggaggagtaccggagattgctgagtcttttggtaatatggaagtgactgatgagtctcctgatcagaagccaggacaatttgaaagagacttgtcgacgagaagcaaagaattcaaagagtttgatcaggactttgactctgttctcggtaaggattcgccggcgaaatttccaggtgaatcaggagttgttttcccggtgggctttggtgacgagtcaggagctgagctggaaaaagattttccgacgagaagtcatgattttgatatgaagactgaaactggaatggacacgaattctccatcaagaagccatgaatttgatctgaagactgaatctggaaacgacaagaattctccgatgggctttggtagtgaatcaggagctgagctggaaaaagaatttgatcagaagaacgattctggaagaaacgagtattcgccggaatctgacggcggtttaggagctccgttgggaggaaattttccggtgagaagtcatgagttggatctgaagaacgaatctgatatcgacaaggatgtgccgacgggatttgacggagaaccagattttctggcgaagggaagacctggatacggtgaggcatcagaagaggataaatttccggcgagaagtgatgatgtggaagtagagactgagctgggaagagacccaaagacggagactcttgatcaattctcaccggaactttctcatcctaaagaaagagatgagtttaaggagtccagagatgattttgaggagacgagagatgagaaaacagaggagccaaaacagagcacttacacagagaagtttgcttcaatgctaggttactccggagaaattccggtgggagatcaaactcaagtggcgggaactgttgatgagaagttgactccggtcaatgagaaggatcaagaaacagagtctgccgtgacgacgaagttacctatctccggaggtggaagtggagtagaggagcaacgaggggaagataaaagtgtgtcgggtagagattatgtggcggagaaactgacaactgaagaagaagacaaagccttttctgatatggttgccgagaaacttcagattggaggagaagaagagaagaaggaaacgacgacaaaggaagtggagaagatctctaccgagaaggcagcatcggaggagggtgaggcggtggaagaggaagtgaaaggaggaggaggaatggttgggaggattaaaggatggttcggtggtggtgcgactgatgaggtgaagccagaatcgccacattctgttgaagaggctccaaaatcatctggctggtttggtggtggtgcgacggaggaggtgaagccaaaatcgcctcattccgttgaagagtctccacaatcacttggctccactgttgttccggtgcagaaggagctttaagaatatgagaactgagattttcaagtttcactttggatgtttatgtgtgttttgtttgacgtctttgatgtattatggtataattccttgtttgtgtgaaaaaaggacatttggttaataaattgttcggctttggatta

SEQ ID NO: 21 - DNA, 1231 bp, Arabidopsis thaliana
gaggaaaaaaaactaaaacggctctaaattgaaaacaaaagaagagagagagagagagagacgaagaaacagagagattctctcgaaaatggccaccattagagtaccaaacgaagttccttctccagctcaggattctgaaactctcaaacaagctattcgcggatggggaacagatgagaaggcgattatacgagttttagggcaaagagaccagagccagagaaggaagattagagaaagttttagagagatttatggcaaagatcttatcgatgttctatcctccgaactgtctggtgatttcatgaaagctgtggtttcgtggacgtatgatccagcagagagagacgcaaggcttgtgaacaagattttgaacaaggagaagaagaagaaaagcttagagaatttgaaggttatagtagagatctcttgcacgacttccccaaaccatttgattgctgtgaggaaagcttattgttcactctttgactcttctcttgaagaacacattgcttcttctctgccttttcctcttgcaaagttactggtgacattggcaagtacattcagatatgacaaagataggactgatgcagaagtagctactattgaggcggctatgctacgtgaagccatagagaagaaacaattagatcatgaccatgtcctgtacatattaggaacgcgtagtatctatcagctcagagaaacttttgttgcttacaagaagaattatggggtcacaattgataaggatgttgatggatgtccaggagatgctgatctgagaagtctattgaaggtggcaatcttttgtattgatactcctgagaaacactttgcaaaggtggtaagagattcgattgagggttttggaacagatgaggattcgttgacgagggcgattgtgacgcgtgcagagatcgatttgatgaaagtaagaggagagtatttcaacatgtataatacaagcatggacaatgctattactggtgatatttctggagactacaaggacttcattatcaccttacttggatccaaaatctgatcgttctttcgtttctttgtcagttgttatattcttggctttgcttgtgacttgtataatcaatcaatacattgtattccaactccagtttgaattgtttaaaaaataatcaaatttctcttgattcttgcatttttgaatcaaagcaaatctatgtttaattttgttttcaaaatt

SEQ ID NO: 22 - DNA, 1195 bp, Arabidopsis thaliana
ccttgaggaaaaaaaactaaaacggctctaaattgaaaacaaaagaagagagagagagagagagacgaagaaacagagagattctctcgaaaatggccaccattagagtaccaaacgaagttccttctccagctcaggattctgaaactctcaaacaagctattcgcggatggggaacagatgagaaggcgattatacgagttttagggcaaagagaccagagccagagaaggaagattagagaaagttttagagagatttatggcaaagatcttatcgatgttctatcctccgaactgtctggtgatttcatgaaagctgtggtttcgtggacgtatgatccagcagagagagacgcaaggcttgtgaacaagattttgaacaaggagaagaagaagaaaagcttagagaatttgaaggttatagtagagatctcttgcacgacttccccaaaccatttgattgctgtgaggaaagcttattgttcactctttgactcttctcttgaagaacacattgcttcttctctgccttttcctcttgcaaagttactggtgacattggcaagtacattcagatatgacaaagataggactgatgcagaagtagctactattgaggcggctatgctacgtgaagccatagagaagaaacaattagatcatgaccatgtcctgtacatattaggaacgcgtagtatctatcagctcagagaaacttttgttgcttacaagaagaattatggggtcacaattgataaggatgttgatggatgtccaggagatgctgatctgagaagtctattgaaggtggcaatcttttgtattgatactcctgagaaacactttgcaaaggtggtaagagattcgattgagggttttggaacagatgaggattcgttgacgagggcgattgtgacgcgtgcagagatcgatttgatgaaagtaagaggagagtatttcaacatgtataatacaagcatggacaatgctattactggtgatatttctggagactacaaggacttcattatcaccttacttggatccaaaatctgatcgttctttcgtttctttgtcagttgttatattcttggctttgcttgtgacttgtataatcaatcaatacattgtattccaactccagtttgaattgtttaaaaaataatcaaatttctcttgattcttgcattttt

SEQ ID NO: 23 - DNA, 1017 bp, Oryza sativa
ggcggatccgtgaagcccaacaacgaatgaagactagtagctgtgctcttcgtccacctcgactcgtcggctcgcctcggcttccttcgttggtccgcaccttctcccctcacccgccgccggggatccgctccgccgtctcgcctcccgccccgtggatccaccttgccgctccagatggaatcctgcccttcggtgaagaacatccttctgctggattccgaggggaagcgcgtcgccgtcaagtactacacggatgattggcctactctctcggcgaagctggccttcgagaagtcggtgttcgtcaagacccagaaagccactgccggagcagaagctgagattgtaatgtttgatggccacattgtggtgtataagttcatccaagacctccatttttttgttactggaggagaggaggagaatgagcttattttagcatcggtccttcaaggattcactgatgcagttgacattattctcagaaataacgtcgacaaaagaacagcactcgaaaatctggatctcatcctattgtgcctcgatgaaattgttgatggagggattgtcctggaaacagaaggaagtgtgatagctgaaaaggtgtcagcacatggaatagaaggtgctacttcactcgctgagcagactatagttcaagccctaacaacagcaagagagcacttgaccaaatctcttcttatgtgatgtgctctgcttttggagctgaagatggagtagcatcccgttgttacatctctaggactgatacgttcattgcaatagaaacgacggaacagaatatctgaatccatttgcgtgtagagtggcacgttcccttcattgacactatctggttcagttttgcgagtatttaaaaaactgcacaaacaagattgtgaacggtgattgtttcaattttgattgttctttgttttgtagatttatatatatgttgttgtgcagtggatcaatatattgcttatggagatgaatgtctttctttaactcgct

SEQ ID NO: 24 - DNA, 1011 bp, Oryza sativa
tcggcggatccgtgaagcccaacaacgaatgaagactagtagctgtgctcttcgtccacctcgactcgtcggctcgcctcggcttccttcgttggtccgcaccttctcccctcacccgccgccggggatccgctccgccgtctcgcctcccgccccgtggatccaccttgccgctccagatggaatcctgcccttcggtgaagaacatccttctgctggattccgaggggaagcgcgtcgccgtcaagtactacacggatgattggcctactctctcggcgaagctggccttcgagaagtcggtgttcgtcaagacccagaaagccactgccggagcagaagctgagattgtaatgtttgatggccacattgtggtgtataagttcatccaagacctccatttttttgttactggaggagaggaggagaatgagcttattttagcatcggtccttcaaggattcactgatgcagttgacattattctcagaaataacgtcgacaaaagaacagcactcgaaaatctggatctcatcctattgtgcctcgatgaaattgttgatggagggattgtcctggaaacagaaggaagtgtgatagctgaaaaggtgtcagcacatggaatagaaggtgctacttcactcgctgagcagactatagttcaagccctaacaacagcaagagagcacttgaccaaatctcttcttatgtgatgtgctctgcttttggagctgaagatggagtagcatcccgttgttacatctctaggactgatacgttcattgcaatagaaacgacggaacagaatatctgaatccatttgcgtgtagagtggcacgttcccttcattgacactatctggttcagttttgcgagtatttaaaaaactgcacaaacaagattgtgaacggtgattgtttcaattttgattgttctttgttttgtagatttatatatatgttgttgtgcagtggatcaatatattgcttatggagatgaatgtctttcttt

SEQ ID NO: 25 - DNA, 2074 bp, Sorghum bicolor
tctgaatagaccgatcagatttggattattattagatgatgatgaaagcaggttaatataactcggaaaatagatctttcagtaatcaaggtattaacaacagcaaatgcagcgactacatcaaagtagccatgccaaggtccagaacaaataacagttgcaaaatgcaaatgctagctagttcttgggcgcattgctctccagctccttcctcagctgcagcgagaagtcatcattgacatcgtcatcatcccagtcatcctcccattgctgaagtgcttcattgccttcttccttgtcatcccactcttgatcgatctcaaactcctcgaactcgtcgtcgtcctcgagcaggtccatcttagcttcctccgtcacctcgggcttcgctggttccgccatcgggactcgcaacactggtggctgctcgtcgccggtgaagggctccaacccgaagatagagatccggaaacctggcgaacggcggcgctggcgctggcgctggcgccggcggtcgcgtagtcgtcgcagaactcacgcgaaggacacggggagaaccgcgatgcgtgggagactggcctggggaagccccggccgsgccggcycttcrgckkctctttcbabccctccwawctccctccactgcttcccctcccctcccctcccccacctccaccatggccacagcagctgcggccaccgccgcctccacctccctgctcgcgccggcggcgagcagcacggcgccgggggcctcgcccaacgcgctgttcttcccctcctccgtgccgtcgctgcgcgcctacccgcggctcctcctcgcgttccgccgccccgccgccgcggccgcccagggcgccgtgctcgaagaggaggaggtacaggccgaccagcggggccagtacgacgacgacgacgacgggtacgagggcgggcgcggccccgcgttcacggcccccacgcggccgcgcaccggcaaggccgcactaccgctcaagcgcgaccgcacgaggtccaagaggttcctcgagatacagaagctgagggagagcaagaaggactacgacgtgcccaccgccatctcgctgatgaagcagatgtccagcgccaagtttgtcgagtcggcggaggcgcacttccgcatgaacctcgaccccaagtacaatgaccagcagctccgggccacggtgaatttgcccaagggaacaggccagtcggtgaagattgcggttctcacacaaggtgagaagatagatgaagctagagctgcaggagcagatatcgtaggtggagaagatttgattgaacaaataaaaggaggatttatggagtttgacaaattgattgcatcacctgatatgatgcctaaggttgccggcttgggtaagattctaggaccaagagggctgatgcctaaccccaaagctggcactgtttctccaaacattactcaggctatcgaagagttcaagaaagggaaggttgaatacagagttgataaatcaggaattgtccatattccctttggcaaggttgactttccggaggaagatctcattgcaaacttcatggccgttgttcgctctgttgagaggaacaagccatctggtgctaaggggatatactggaaaacagcgtacttgtgctcatccatgggaccttctatcaagctaaacataaaagaaatgcttgattatggtttggactcatctgactagatgtgaccacaggcaccagttaagtcagattaactatctgccccttgcgacaaatgagcggagacatggttgtggggtatggcaaggaggtgcttaggtacagttttttcagttttacgggcacccatcatcagagcagctaaagtatgcccagatcgacaaagaggtggtcttgttggtcatgtatttatgagcaaattattcatggtttcatagatgtctgtctctgagacgtttgttgtaatgtttcatattctgtcaatagtcatccttgagcttaagccagcaatttattttcacctgtcattaacataagtacttaccgttcatgtttgtgttggcgagtcggcatgtat

SEQ ID NO: 26 - DNA, 1212 bp, Oryza sativa
gatgtctctggtatcttccgagcacaagaaatctggaccgtccgttccgtcaccgactcccgtctctcccctctccgtggctctctctctccacgcgacgcgctctctcgtttcgtctcgtcgtcctcccggagcgaccgcctttcgccctccctccatggcgtcgacggatgccgacgaggaccagctcctcaagagcttcctcgccgaggtcagcgaggccgaacgcgacaacgaagtgctcaggattcttggttgcttcaagttaaaccctttcgagcatcttaagttgtcatttgattcatcagcagatgaggtgaagaagcaatataggaagttgtccttgttggttcatcctgataaatgcaagcatccgaaagcacaagaagctttcgcagctctggcaaaagcacagcagctcctacttgatccacaggagagaggatatattcttgatcaagttactgctgcaaaagaagagctgagggcaaagaggaaaaaggagctgaagaaagacagcgcgtcaaagataaagtcccaagtagatgagggaaaatatgaagagcagtatgaacgatcagaagaatttcagaagcagctaataattaaagttcgtgaaattttgacagacaaagagtggcgtcgcaggaaaatgcagatgaggatatcagaggaagaaggaagactgaagaaggatgaagaggaaacaaaagaaatgtggaagaagaagcgggagcatgaagagaagtgggaagagaccagagaccaacgagtctctagctggagggattttatgaagacaggaaagaaggcaaggaaaggtgagatcaaacccccaaagctgaagaccgaggatccgaacaaatcttatgttcagaggccggtgaagcgtgcttaagaggaatgatgttagtctttgcagccaaagcatatatacagtaaccattcttcttgttacccgatctaagctttatcctatcaaagctcctggcaggctgtaaggttcggttatgccttccgtgttcccactgtagtcagggaacataacacatctttgttagcagaatggcttcatgttctctacatagagttgtattggattaatgtacctcttggatataacacattcctggaaaatgttgaaaaaaatatgtgaaaaagaaactcatcgaattgaatgctgaaatgccctccaacggatcattgttccat

SEQ ID NO: 27 - DNA, 1211 bp, Oryza sativa
atgtctctggtatcttccgagcacaagaaatctggaccgtccgttccgtcaccgactcccgtctctcccctctccgtggctctctctctccacgcgacgcgctctctcgtttcgtctcgtcgtcctcccggagcgaccgcctttcgccctccctccatggcgtcgacggatgccgacgaggaccagctcctcaagagcttcctcgccgaggtcagcgaggccgaacgcgacaacgaagtgctcaggattcttggttgcttcaagttaaaccctttcgagcatcttaagttgtcatttgattcatcagcagatgaggtgaagaagcaatataggaagttgtccttgttggttcatcctgataaatgcaagcatccgaaagcacaagaagctttcgcagctctggcaaaagcacagcagctcctacttgatccacaggagagaggatatattcttgatcaagttactgctgcaaaagaagagctgagggcaaagaggaaaaaggagctgaagaaagacagcgcgtcaaagataaagtcccaagtagatgagggaaaatatgaagagcagtatgaacgatcagaagaatttcagaagcagctaataattaaagttcgtgaaattttgacagacaaagagtggcgtcgcaggaaaatgcagatgaggatatcagaggaagaaggaagactgaagaaggatgaagaggaaacaaaagaaatgtggaagaagaagcgggagcatgaagagaagtgggaagagaccagagaccaacgagtctctagctggagggattttatgaagacaggaaagaaggcaaggaaaggtgagatcaaacccccaaagctgaagaccgaggatccgaacaaatcttatgttcagaggccggtgaagcgtgcttaagaggaatgatgttagtctttgcagccaaagcatatatacagtaaccattcttcttgttacccgatctaagctttatcctatcaaagctcctggcaggctgtaaggttcggttatgccttccgtgttcccactgtagtcagggaacataacacatctttgttagcagaatggcttcatgttctctacatagagttgtattggattaatgtacctcttggatataacacattcctggaaaatgttgaaaaaaatatgtgaaaaagaaactcatcgaattgaatgctgaaatgccctccaacggatcattgttccat

SEQ ID NO: 28 - DNA, 969 bp, Glycine max
tgctttgactttgtttcataggctcctttttgattacgaaaatgtggaagagaacgggttttgaagaagaagcagttcaattgatcaactcagatttcagggacctaagtctagctgctaatagactcgcccatcatgccatcaaacttggtggcattggctttggagcctcttttttcggattgtttgctgccattgctgctatttatctgttgattttggatcgtacaaactggaaaacaaatattctcacagcactactcattccatacattttcttcagcttgccttcattaattttcgacgtcttcaggggagagcttggaaaatggattgctgcagttgctgttgtattacgccttttccttccaagacacttccctgattggctggaattgcctggtgctctgattcttcttatcgttgtagctccttctctaattgcaagcacctttagagacaacattgttggggtggtagtgtgcctcatcattgcatgttatttgctgcaagaacacattcgggcttctggtggtttcagaaactccttcactaaagctcacggcatatcaaattccattggcataatacttctgttggtttatcccatctgggcgctggtggtcatacttttttaggcaccaccatttggacttggttgatatgtgagaattaaaccaagtgtcttctgtatcattcatttgttgcaacttgatatctataaacacccggccattgttttgtgattcatgtttgtcctaagacctaaagttagcatgtgttaaaaagtggaataaaatctcagtttaagtcctctggtttcatagaatgtagaaaacaaaagatgaagaggattgatgtggtgtctttctagctgtcgtgtattcataaatcatgtatgatttgggaaatcgttgtatttttacctgtgggatataatataaatttacatttgttgctgctctgtat

SEQ ID NO: 29 - DNA, 2072 bp, Hordeum vulgare
gcccacaaccaaatatatacaagtctcctccaatcttcgctggtgctttgacgatggccaccaagaactatggtgaattgtacaacatgctcggctggggtgaaccttacttcatcgtgaacacggatggccacctatgtgtcaagaccaacggccacgagacaaagccagggcaagagatagacgtggtgtccgttgttgaagctgcaaaggaagagggcgtccagtttccgatgatcctccgcttccccggcgtgctcaagcaccgcgtcgactcgctccacgttgcattcgagaacgccatcaagcacaccgggtacacggcgccatatcagggcgtgtacccagtgaaggtgaatcagaacaaggccatcatcaacgactttgttaccttcggccaccgttatagctacgggctagaggcgggctccaagccggaattgctcatcgcaatgagctaccttaccaaagccaagcccggagccttcttggtgtgcaatggctacaaggacgcggagtatgtggcgctggcgctctcggcgcgtgccatgggcctcaatgtcatcatcgtgttggagatggaggaggagctggacatcgtcatcgaccagagcaacaagctcggggtggagccggtgctgggcgtgcgtgccaagcttctcaccaagattccaggccacttcgggtcgacggccggcaagcatggcaagttcggcctcctcgcggagaagatctacgaggtggccaagaagctccagggtctcaacaagctgcactggctcaagctgctacactttcacatcggctccatgatcccgaccacggacattgtgtccaatgcagccagggaggcctccggcatctactgcactctggtgaaccagtatggcgcgcagatgaccacgctggactgcggcggagggctcggcgtcgactacgacggcacccggtcaggtagctccgacatgtcggtggcatatgggttggaggagtatgcgtccagcattgtgcaggcggtgcggctcacgtgcgagtacaatggtggcgttccccaccctgttttgtgcaccgagagcggccgcgccatggtgtcgcatcactcgatgatcatcctcgaggccctctcggcgatccctgagcccaaggacgacgataccccygagcagctgcacggcaagatccagcatctttcatccaatgtgccgtcgccgagagcactcgtggccacggacctccagaagcacgccaccgacatccagaagcacgggatcgagatgtacaagctggccaagaagctctccaagcggatcgccggggacgccaacaccatctacaactaccacatgaacctctccatcttctcgctcgttcccgacttctggggcatcaagcacctcttcccgatgatgcccgcgagccggctcaacgagaagccgactcaaatgggcacgctcatcgacatcacatgcgacagcgacggaaaggttgacaagttcatcggcaatgccgacacgctgccgctgcacacgctggaccctgagagcgacggctactacgtggccgtgctcctgtccggcgcgtaccaggaagccctttcttgcaagcataacctgttcggcggcccaagcatagtccgggtcgagaacaacaccgacggtggtggtggcttccacatcgccacagccgaccttggcccgacgacggaggagctcatcagcaccgtggggtacgatgtcaaggaggacattcgcggcgtgatcgaaaaatgggccagggagaaggaggtgtgggagaaggtgggggtgttcgtggaggctgggcttacctccatgccctacctcgtcgaatacaaggtcccgcgaaccgcctaatttcatcgtgattcatatttcatgctatttcttttatccacactttggctttaaataagcgtagccggcatgcctgcctcattcgtacgtgtaggacaggctttgggttccgccattccacgccatgctttgccattttctattgaagaataaataaagttcatctccccttctcatttgtttactcttatttatgttcag

SEQ ID NO: 30 - DNA, 1121 bp, Sorghum bicolor
gcacgagggcggcgccgaggtggcgaactactgccgggagaggctccaggtgctgttgcggcaggagctgaggctactcggcaaggatttgggggagacaagcgaggtggagatgaaggagcactgggacgacctgttcaccaggtgtttccagaggctggacgacgaggtgtcagggcaggcgagcaggctcgtcggtggcgttcaggagtcacggccggtggccgccgagaacgtgggctcgactgcggttgtcgccgtcgtgtgctcgtcccatgtggtggtcgccaactgcggggattcgcgtgttgtcctctgccgtggaaaggagcccgtagagctgtcgattgatcacaagcctgacaggaaggatgagcgggcgaggattgaggccctgggaggcaaggtcatccaatggaacggttaccgggtctccggtatacttgctatgtcaagatcgattggggaccggtatttaaaaccattcgtcattccaaaaccagaagttacagtctttcctagggcgaaagatgatgactgcctcattcttgcaagtgatggactgtgggatgtcataccgaatgaagaggcatgcaaagttgcacggcgtcaaatccaactgtggcacaagaacaatggtgtcgcatcatcattgtgtgatgagggtgatgaatccactgatcctgctgcacaagctgcagctgattatcttatgaggctcgcactgaagaagggtactgaggacaatatcactgtcattgtggttgatttgaaacctcgaaagaagctcaagagcaactcataacattgagctggatccatcagagttagagctgaccatgatatgtccaaagacttctattgctagttggtcgtccggatgagacttgacccacattttttttttcgttgggcctcaagaattgtacatgtatatgctagatgcattttccgtagagggttatgcttaaccccactctatttctagtggctaaaatattctccaatcggcttctaccttgagccctggcacttggtatatccccaatgctgtatgatagtcgaacttgtaaagagccaagcggctgagacggtcactaaaattaacatattgttacctt

SEQ ID NO: 31 - DNA, 1859 bp, Sorghum bicolor
agcggcgtgacgagtcggggagacctgcccgctacggcgagggccccgggccaatcccctcctccaacctcgcttcttcccctcctcctcctcctcctcttcccccacccctgcttctttccccttcccccttccccctctctctctcaccccaccctcctcctcggcttcctcatcatccgccccaccgagactgtagtcccctcctcctactgcaaggcccgcccgtccgacccgccgcttcctcgcgtctcaggttcgtgcctggtggccgactctcgcggtggcggtggttctccggcgcctcggttgggcaggggacgagcgggttagggacagagggggtctttgctgcgattccgtgatggcggcgacggcggccatctgcgtggaggacgaggcgacctgcgccgccgcggaatgcgcgccgggggtcgagaagctggatctcgctgccgccggcgccggcgccgacggcaaggccggcggcagcaagaggagcgtctacctcatggactgcgcgccggtctggggctgcgcgtccacgcgcggccgcagcgccgagatggaggacgcctgcgccgcgttcccgcgcttcgccgacgtgccggtgcgcctgctcgccaggcgccgggacctcgacggcctgggcctcgacgccgacgcgctccgcctgccggcgcacctgttcggcgtcttcgacggccacggcggcgccgaggtggcgaactactgccgggagaggctccaggtgctgttgcggcaggagctgaggctactcggcaaggatttgggggagacaagcgaggtggagatgaaggagcactgggacgacctgttcaccaggtgtttccagaggctggacgacgaggtgtcagggcaggcgagcaggctcgtcggtggcgttcaggagtcacggccggtggccgccgagaacgtgggctcgactgcggttgtcgccgtcgtgtgctcgtcccatgtggtggtcgccaactgcggggattcgcgtgttgtcctctgccgtggaaaggagcccgtagagctgtcgattgatcacaagcctgacaggaaggatgagcgggcgaggattgaggccctgggaggcaaggtcatccaatggaacggttaccgggtctccggtatacttgctatgtcaagatcgattggggaccggtatttaaaaccattcgtcattccaaaaccagaagttacagtctttcctagggcgaaagatgatgactgcctcattcttgcaagtgatggactgtgggatgtcataccgaatgaagaggcatgcaaagttgcacggcgtcaaatccaactgtggcacaagaacaatggtgtcgcatcatcattgtgtgatgagggtgatgaatccactgatcctgctgcacaagctgcagctgattatcttatgaggctcgcactgaagaagggtactgaggacaatatcactgtcattgtggttgatttgaaacctcgaaagaagctcaagagcaactcataacattgagctggatccatcagagttagagctgaccatgatatgtccaaagacttctattgctagttggtcgtccggatgagacttgacccacattttttttttcgttgggcctcaagaattgtacatgtatatgctagatgcattttccgtagagggttatgcttaaccccactctatttctagtggctaaaatattctccaatcggcttctaccttgagccctggcacttggtatatccccaatgctgtatgatagtcgaacttgtaaagagccaagcggctgagacggtcactaaaattaacatattgttaccttaatgattcaaggcctacccatgtctgtatccgatgg

SEQ ID NO: 32 - DNA, 1975 bp, Arabidopsis thaliana
aacacagaactagaaaagagaaacactattagatcatcacttctcagatttcgatattcccaataaataataaatactctcagttcttctcttctccaagaacaaaaaaaaaaaatgaattcagaatcgctagaaaatcttcaccgtccattaatcgaatcatcgaagtcgttcgtcgattatcgtctcgagactgtgttaacagatcgagagttaccgtattttcgccggatttatctagcgatgatgattgagatgaagtttctctttcatctggcggctccggcgatctttgtttacgtcatcaacaacggcatgtcaattcttacacgtatcttcgctggacacgtaggaagcttcgaactcgccgccgcttcacttggaaacagtggtttcaacatgttcacctatggacttctgcttggaatgggaagtgcagtggaaacattatgtggtcaagcacatggagctcatagatacgaaatgcttggagtttacctccaaagatcaacagttgttctaatcctaacatgtctaccaatgtcatttctcttcctcttctcaaatccgatcctcacagcacttggagagccagagcaagtggcaacattggcttcagtattcgtctacggtatgatcccggtgatcttcgcttacgcagtcaatttccctatccagaagtttctccaatcacaaagcatcgtcactccaagtgcctacatatcagctgcaacgcttgtgatccatctcatactttcgtggatcgctgtgtatcgtcttggttacggtcttttggctttgtctttgatacatagcttctcgtggtggatcattgttgtggctcagattgtttatattaaaatgagtccgagatgtcgtcggacttgggaaggttttagttggaaagcttttgaaggtctttgggattttttccgattatcagctgcttctgccgtcatgctttgtcttgaatcttggtactctcagattcttgttttactcgccggacttctcaagaaccctgagcttgctttggattctcttgctatctgcatgtcaatttctgcaatctcattcatggtctccgttggattcaacgcagctgcaagtgtgagagtaagcaacgagctaggagccggaaacccgagagcagccgcgttctccacagtcgtgacaacgggagtatcattcttactatcggttttcgaagccatcgtggtcttatcgtggcgtcacgtcatcagctatgcgtttactgatagtccagcagtggctgaggccgttgcggatttatctccctttttagccatcacaattgtcctcaatggaattcagcctgttttgtccggtgtggctgttggatgtggatggcaagcatttgttgcgtacgtaaacattggatgttactacgttgtggggattccagtgggattcgttcttggcttcacttatgatatgggagctaagggaatatggactgggatgattggtggtactttaatgcaaacaataatcttagtgattgtcactttacgaactgattgggacaaagaggttgagaaagcttcgagcagattggaccagtgggaagagagccgtgagccgcttttgaagcaataaataaattaatgaaatgatttgtttatttttattttttttgggagttttgaggtcagattgaaatcaaaatttttgtttccccgaaatatggcgatagatgatcacttgtaagatgcatattcaattgttaaactctcgtttttcaatcgaaaaatgtatatcgctttgttatttaatgacttggaaatttgagttttttttttggtttcttggtgttgtgggagttttttttttgatggacatttgagattagaatatataggagcaaagttgaaagtttatttcagtgtatgattgtatatgaaaataaagagtgagttgtttcttcttaccaacttctgtcagtttttagcta

SEQ ID NO: 33 - DNA, 1978 bp, Arabidopsis thaliana
aacaacacagaactagaaaagagaaacactattagatcatcacttctcagatttcgatattcccaataaataataaatactctcagttcttctcttctccaagaacaaaaaaaaaaaatgaattcagaatcgctagaaaatcttcaccgtccattaatcgaatcatcgaagtcgttcgtcgattatcgtctcgagactgtgttaacagatcgagagttaccgtattttcgccggatttatctagcgatgatgattgagatgaagtttctctttcatctggcggctccggcgatctttgtttacgtcatcaacaacggcatgtcaattcttacacgtatcttcgctggacacgtaggaagcttcgaactcgccgccgcttcacttggaaacagtggtttcaacatgttcacctatggacttctgcttggaatgggaagtgcagtggaaacattatgtggtcaagcacatggagctcatagatacgaaatgcttggagtttacctccaaagatcaacagttgttctaatcctaacatgtctaccaatgtcatttctcttcctcttctcaaatccgatcctcacagcacttggagagccagagcaagtggcaacattggcttcagtattcgtctacggtatgatcccggtgatcttcgcttacgcagtcaatttccctatccagaagtttctccaatcacaaagcatcgtcactccaagtgcctacatatcagctgcaacgcttgtgatccatctcatactttcgtggatcgctgtgtatcgtcttggttacggtcttttggctttgtctttgatacatagcttctcgtggtggatcattgttgtggctcagattgtttatattaaaatgagtccgagatgtcgtcggacttgggaaggttttagttggaaagcttttgaaggtctttgggattttttccgattatcagctgcttctgccgtcatgctttgtcttgaatcttggtactctcagattcttgttttactcgccggacttctcaagaaccctgagcttgctttggattctcttgctatctgcatgtcaatttctgcaatctcattcatggtctccgttggattcaacgcagctgcaagtgtgagagtaagcaacgagctaggagccggaaacccgagagcagccgcgttctccacagtcgtgacaacgggagtatcattcttactatcggttttcgaagccatcgtggtcttatcgtggcgtcacgtcatcagctatgcgtttactgatagtccagcagtggctgaggccgttgcggatttatctccctttttagccatcacaattgtcctcaatggaattcagcctgttttgtccggtgtggctgttggatgtggatggcaagcatttgttgcgtacgtaaacattggatgttactacgttgtggggattccagtgggattcgttcttggcttcacttatgatatgggagctaagggaatatggactgggatgattggtggtactttaatgcaaacaataatcttagtgattgtcactttacgaactgattgggacaaagaggttgagaaagcttcgagcagattggaccagtgggaagagagccgtgagccgcttttgaagcaataaataaattaatgaaatgatttgtttatttttattttttttgggagttttgaggtcagattgaaatcaaaatttttgtttccccgaaatatggcgatagatgatcacttgtaagatgcatattcaattgttaaactctcgtttttcaatcgaaaaatgtatatcgctttgttatttaatgacttggaaatttgagttttttttttggtttcttggtgttgtgggagttttttttttgatggacatttgagattagaatatataggagcaaagttgaaagtttatttcagtgtatgattgtatatgaaaataaagagtgagttgtttcttcttaccaacttctgtcagtttttagcta

SEQ ID NO: 34 - DNA, 2777 bp, Oryza sativa
atcccatttattttttcctctcaaaagatcacaattttttcatcttcttctcgtgatatcctttgttttttttcatccatccatccattcccctttgcacggttgagctcgtctcacagttgttaattaacagcaagaacatttttttccttaaatttctatttaatttatactacttgcgagcgagagccacctaatcttggtgcccaccaagcataagcttcatcatcttcttcttctttgaagtcgtcttcttccctcctcctctcgtcgcctcttggaaagagagagagagagagagagagagagagagagagaggtgatcgagttgcagcaatggcgaggagggcgccatggctcgccgggattggggccgtgccgttcttgatcgtcgtcgtggtggcggtggtgggcgccgccgtgccggcgatggggaggttcgtggtggagaagagcagcgtgagggtgctctcgccggagcacatccgggggcaccacgacgccgccatcggcaacttcggcgtgccggactacggcggcacgctcaccggcgtcgtcgtctaccccgacaagaaggccaccggctgcgccgagttcgacgccaagttcaagtccaagtctcgccgcccggtcatcctcctgctcgaccgtggagagtgctacttcgcgctgaaggcgtggaacgcgcagcaggcgggcgcggcggcggtgctgatcgcggacaacgtggacgagcagctgctgacgatggacacgccggaggagtcgccggagacggagtacatcgaccggatcagcatcccgtccgcgctggtcaaccgcgcgttcggcgagtccctcaagaggatgtcgtcgccgtcgccgtcgtcagaggcggcggtggaggtggtggtgaagctggactggcgcgagtcgatgccccaccccgacgagcgggtggagtacgagctgtggaccaacagcaacgacgagtgcggcgcccggtgcgacgagcagatggagttcgtccgcggcttccgcggccacgcccagatcatggagagaggtggctacgccctcttcaccccgcactacatcacctggtactgccccgaggccttcaagctcacccagcagtgcaagtcccagtgcatcaaccatggcaggtattgtgcgccggacccggagcaggatttcggggaggggtacgaggggaaggacgtggtggtggagaacctgaggcagctgtgcgtgcaccgggtggccaacgagaccgggcggccatgggcgtggtgggactacgtcatggactacaagatcaggtgctccatgaaggagaagaagtacagcaagggctgcgccgaggacgtcgtcaaggccctaggtctgtcgcttgacaaggtgctggaatgtatgggcgatccagaggccgacaccgacaacgccgtcttggccaaagagcaggaagatcagattggccgtggatcgcgaggggatgtgaccatcttgcctactctcgtcatcaacaacgtccagtacagagggaaactggagaggacggccgtgctgaaagctgtctgtgccggcttcaaggagggcactgaacctcgcgtctgcttgagcaatgatatcgagacgaacgagtgcctgcacaggaacggcggttgctggagagacgagaaaaccaacgttacggcttgcaaggacacgttcaggggtagggtgtgcgagtgcccagtggtgaatggcgtccagtacgagggcgacgggtacatcggttgcaaagctgttgggccaggcaggtgtacggtggacaacggaggctgctggtcagagactaggggtcatcagacgttctctgcttgctctgacactgcattgactggatgccgatgccccccgggtttccaaggagatggccacaaatgtgaagatttggatgaatgcaaggagaagcttgcgtgcacttgccctaactgccactgcaagaacacctggggcaactacgagtgcaagtgcaagggcaaccagatctacataagaggagaggacacatgcatagccaacagcatgtcaaggttcggctggttcatcactatattggtggcgtcgtgcgtagccggcgtggggattgccggctatgtgttctacaagtacagactcaggtcgtacatggactcggagatcatggccatcatgtcccagtacatgccgcttgacagccagaacaacgagaaccaaccccttcgacagcatgattcagaggcttaagggacctggccatttgatggagaatttggttagctatataccttgtgaagagattgatacaaagatgggctatgagttcaagggaactagttatggtgatcccagaccatactcagcagatacttaagtgtgcttccaatgattttagcttcatttttgtatagtaaaagaaatggtttgtaccgagccacagtgattgagcaatagagaagtagctaggtaggcatttctgctctcatgtggaacgacatacaatacaatacacacagaatttttagaaaagaaaaatacaggtggcggtgtatcatagtcatagataaccatattaagaaaaatatggatggcggtgtatcaaaaaccataaaataaggtgtttctgtctatttggagttgttttggcatgctttcctgaaaacaccaggctcttgttttcagaaatccatgataagagagttgatcacttgctggttttcttgtgggctatgatatcggccgacggccaagtatctaataaaagattcttgatc

SEQ ID NO: 35 - DNA, 2734 bp, Oryza sativa
gcctcacacctctcctcctctcaccttctcttctacgtcacaaaagttgacacctttgcccctctcgaaccaaacggatttcagtacaacccaagcaatccaatcccatttattttttcctctcaaaagatcacaattttttcatcttcttctcgtgatatcctttgttttttttcatccatccatccattcccctttgcacggttgagctcgtctcacagttgttaattaacagcaagaacatttttttccttaaatttctatttaatttatactacttgcgagcgagagccacctaatcttggtgcccaccaagcataagcttcatcatcttcttcttctttgaagtcgtcttcttccctcctcctctcgtcgcctcttggaaagagagagagagagagagagagagagagagagagaggtgatcgagttgcagcaatggcgaggagggcgccatggctcgccgggattggggccgtgccgttcttgatcgtcgtcgtggtggcggtggtgggcgccgccgtgccggcgatggggaggttcgtggtggagaagagcagcgtgagggtgctctcgccggagcacatccgggggcaccacgacgccgccatcggcaacttcggcgtgccggactacggcggcacgctcaccggcgtcgtcgtctaccccgacaagaaggccaccggctgcgccgagttcgacgccaagttcaagtccaagtctcgccgcccggtcatcctcctgctcgaccgtggagagtgctacttcgcgctgaaggcgtggaacgcgcagcaggcgggcgcggcggcggtgctgatcgcggacaacgtggacgagcagctgctgacgatggacacgccggaggagtcgccggagacggagtacatcgaccggatcagcatcccgtccgcgctggtcaaccgcgcgttcggcgagtccctcaagaggatgtcgtcgccgtcgccgtcgtcagaggcggcggtggaggtggtggtgaagctggactggcgcgagtcgatgccccaccccgacgagcgggtggagtacgagctgtggaccaacagcaacgacgagtgcggcgcccggtgcgacgagcagatggagttcgtccgcggcttccgcggccacgcccagatcatggagagaggtggctacgccctcttcaccccgcactacatcacctggtactgccccgaggccttcaagctcacccagcagtgcaagtcccagtgcatcaaccatggcaggtattgtgcgccggacccggagcaggatttcggggaggggtacgaggggaaggacgtggtggtggagaacctgaggcagctgtgcgtgcaccgggtggccaacgagaccgggcggccatgggcgtggtgggactacgtcatggactacaagatcaggtgctccatgaaggagaagaagtacagcaagggctgcgccgaggacgtcgtcaaggccctaggtctgtcgcttgacaaggtgctggaatgtatgggcgatccagaggccgacaccgacaacgccgtcttggccaaagagcaggaagatcagattggccgtggatcgcgaggggatgtgaccatcttgcctactctcgtcatcaacaacgtccagtacagagggaaactggagaggacggccgtgctgaaagctgtctgtgccggcttcaaggagggcactgaacctcgcgtctgcttgagcaatgatatcgagacgaacgagtgcctgcacaggaacggcggttgctggagagacgagaaaaccaacgttacggcttgcaaggacacgttcaggggtagggtgtgcgagtgcccagtggtgaatggcgtccagtacgagggcgacgggtacatcggttgcaaagctgttgggccaggcaggtgtacggtggacaacggaggctgctggtcagagactaggggtcatcagacgttctctgcttgctctgacactgcattgactggatgccgatgccccccgggtttccaaggagatggccacaaatgtgaagatttggatgaatgcaaggagaagcttgcgtgcacttgccctaactgccactgcaagaacacctggggcaactacgagtgcaagtgcaagggcaaccagatctacataagaggagaggacacatgcatagccaacagcatgtcaaggttcggctggttcatcactatattggtggcgtcgtgcgtagccggcgtggggattgccggctatgtgttctacaagtacagactcaggtcgtacatggactcggagatcatggccatcatgtcccagtacatgccgcttgacagccagaacaacgagaaccaaccccttcgacagcatgattcagaggcttaagggacctggccatttgatggagaatttggttagctatataccttgtgaagagattgatacaaagatgggctatgagttcaagggaactagttatggtgatcccagaccatactcagcagatacttaagtgtgcttccaatgattttagcttcatttttgtatagtaaaagaaatggtttgtaccgagccacagtgattgagcaatagagaagtagctaggtaggcatttctgctctcatgtggaacgacatacaatacaatacacacagaatttttagaaaagaaaaatacaggtggcggtgtatcatagtcatagataaccatattaagaaaaatatggatggcggtgtatcaaaaaccataaaataaggtgtttctgtct

SEQ ID NO: 36 - DNA, 2373 bp, Solanum lycopersicum
gacacaaaaactccaaaaagtctcctctgttcacagagtcttctcttgacactttcttgatttttggccccttatgtaatccatctgtttctttctcctctttacacctcttacaaactttttgaaaccccaaacattacaaattgtaccaatactaaatatgcttgtacctttacactctcctgcaaacatggctgctctgttttttcgacttctgtttttttccttgatagtatcgaatgttgtgctagttcaggcaaggtttatagttgagaagaacagtataagtgttctgtctccttattcaatgcactcgaagcatgatgcctctattggtaattttggtgtccctgattatggtggttctttagttggaactgttgtttatcctagtaaaggtgctaatggctgcgctgaatttgatggtgataaacccttcaaatctaagggtcatcgtcctaatatccttcttcttgatcgtggagactgctattttgctttgaaggtatggaatgggcaacaagctggagcagctgcagtactagttgctgatagtatagatgaggctcttataactatggattctcctgaagaaagtacggatgccaatggatacatcgagaagattggtatcccgtcagcattgattgaaaagtcgtttggtgacgcattgaaagaagctcttaagaagggagaggaagttgtgatcaaaatggattggacggagtcaatgcctcatcctgatcagcgagttgagtatgaattgtggactaatagcaacgatgagtgtggggttcgttgtgatgagcagatgaatttcatcaagaacttcaaaggacatgctcaaatacttgagaagggcggttatactatgttcacgcctcattatattacttggtactgtcctgaagctttcattcttagcagccagtgcaaatctcagtgcattaatcacgggagatattgcgctcctgatccggagcaggactttggggaggggtaccaagggaaggatgttgtctttgagaacttgaggcagctttgcgtgcatagagttgcaaatgagagtagccgttcttgggtttggtgggactatgtgacggattttcatattagatgttcaatgaagcaaaagcgatacagcaaagaatgtgctgaggaggtcatgaaatcacttgatctaccggttgacaagataaagaaatgcatgggcgatccagaggctaatgttgaaaatgatgtgttgaagactgagcaagacctccaggttggccgaggacctcgtggagatgtgacaatcttaccaacaatggtcatcaatgatattcaatatcgagggaaattggagaggactgctgttttaaaagccatatgtgctggttttaaggaaacaactgaaccttcgatatgtttaagtggagatcttgaaacaaaccagtgcctagaaaggaacggtggctgttggcgggatcctaaatctaacataactgcctgcaaggatacatatagaggaagagtttgtgagtgccctttggtgaacggcgttcagtataaaggagatggatacacatcttgtgaagccgttggacctggaaggtgttcggtaaacaacggaggatgctggtcagaaaccagaaatgggcaaacatattcagcatgttcagagggtgaactatcaggctgtaagtgtccgtatggttttaaaggggatggccataaatgtgaagatgtagatgaatgcaaggaaggacttgtttgtcagtgtgatggctgcagctgtaaggacacatggggtggattcgagtgtaagtgcaaaggaaatcaactctacataatggagcatgatacttgtatagaaagacactcatcaaagatcggacgggtccttatgttctctttcctagccattgcagtgggggctggtttagctggttacaccttttacaagtatagacttcggtcatacatggactcagagattatggccatcatgtcgcagtacatgcctctcgacaaccacaatcagaatcaggttgtccatcatgaagctgaacctctacaacagagctcggtatgatgagtatttctgggagctaatgtatgatttcccatccttctcttggatacttttcgacttatggatattgaaggagatgaagaacagagtcatatttagaggaaaaccagatacttgatgctggtttgccaactctctagtccataaagacctggcttttcccatttgtgtataatagagttttgagatgtaaatgcagggttcacttgtgttaaaaggacatatagaacaaaatatacttgggaaggcaacccatggccttttacattattcagcaattgcatccttcttaaatc

SEQ ID NO: 37 - DNA, 707 bp, Oryza sativa
aagagaaccattagtcaaaccaaattaccaacaaagtacacctctcccttgctagggtttgttccctctcccaatctccaaagtgtcatttcacattgacttcattcttcttcccagatcccccaatttctccctttcaccatgaagcttctccctcttctcatcctcgcaatggtcatggccaacgccttcggcgccgtcacttctcgcacggcgccgggggaggaggcgctgctggcgcacggcgtggtgaagacgacgacggcggaggggacgtccatcgacaaccaccacgcgataccgcggccggagtacgacagctggagcagcccggggaacatgccggggagtggccatgacattgggagcgaacaagctcagccatgatcgagctagatgcagcttacccagctctacccatgtcctgtacgtatatacatagcaagcttgcaagccatgggttatacacttattacgtacgcttgattgcatgtagctagtatccatatatgtacggttgtggctctagttgtggttgcatgataattcgaagatgctttgtagtttctacagtgattgtatatttgtattgctcatgtaaaagtgtttaactgtatttaacctcatcacgtgtactaatgttaattaattaaatactgaataaaatttatacgtccctacatgaagggagagttcttgttttctca

SEQ ID NO: 38 - DNA, 1136 bp, Oryza sativa
tggatccccttcttctgccgctcgttttccattgccgacgcgcagcacgcagctgcgcagccacacctttgcggctgtcttatcttgttcttgagttgtgttcttggttggggaggaggaggaggagatgaagatccagtgcgacgcgtgcgagagcgcggcggcggcggtggtgtgctgcgcggacgaggcggcgctgtgcgcggcgtgcgacgtggaggtgcacgcggcgaacaagctggccgggaagcaccagcggctgccgctggaggcgctctcggcgaggctcccgcgctgcgacgtgtgccaggagaaggcggcgttcatcttctgcgtggaggaccgcgcgctcttctgccgcgactgcgacgagcccatccacgtccccggcacgctctccggcaaccaccagcgctacctcgccaccggcatccgcgtcggcttcgcctccgcctcgccctgcgacggcggcagcgacgcccatgactccgaccaccacgccccgcccatgggctcctccgagcatcatcaccatcatcagcagccggccccgaccgtcgccgtcgacacgccctcgccgcagttcctgccgcagggctgggccgtcgacgagctcctccagttctccgactacgagaccggcgacaagctgcagaaggagtcgtcgccgccgctcgggttccaggagctggagtggttcgccgacatcgacctgttccacaaccaggcgcccaagggcggcgccgccgccggccggacgacggcggaggtccccgagctcttcgcttcgcaggcggccaacgacgtggcgtactacaggccgccgaccaggaccgccgccgccgccttcaccgcggccaccggcttccgccagagcaagaaggcccgcgtcgagctccccgacgacgaggaggattacctcatcgtccctgatcttggttgaatcttgaagaggagttcgttccagaggagaagatcctcctcctgtgttcttgggttttgccatgtccttgtgttttctgcttgtatgctagcttttgtgtttaacgttagtcctgctcaactgtgacatatttgagccactctgcttccgtcccatgccatcagtgatcaatctgatataagtttttctgaaa

SEQ ID NO: 39 - DNA, 1240 bp, Oryza sativa
cgggtttatatgcgccactagccgagccgcgcttctggatccccttcttctgccgctcgttttccattgccgacgcgcagcacgcagctgcgcagccacacctttgcggctgtcttatcttgttcttgagttgtgttcttggttggggaggaggaggaggagatgaagatccagtgcgacgcgtgcgagagcgcggcggcggcggtggtgtgctgcgcggacgaggcggcgctgtgcgcggcgtgcgacgtggaggtgcacgcggcgaacaagctggccgggaagcaccagcggctgccgctggaggcgctctcggcgaggctcccgcgctgcgacgtgtgccaggagaaggcggcgttcatcttctgcgtggaggaccgcgcgctcttctgccgcgactgcgacgagcccatccacgtccccggcacgctctccggcaaccaccagcgctacctcgccaccggcatccgcgtcggcttcgcctccgcctcgccctgcgacggcggcagcgacgcccatgactccgaccaccacgccccgcccatgggctcctccgagcatcatcaccatcatcagcagccggccccgaccgtcgccgtcgacacgccctcgccgcagttcctgccgcagggctgggccgtcgacgagctcctccagttctccgactacgagaccggcgacaagctgcagaaggagtcgtcgccgccgctcgggttccaggagctggagtggttcgccgacatcgacctgttccacaaccaggcgcccaagggcggcgccgccgccggccggacgacggcggaggtccccgagctcttcgcttcgcaggcggccaacgacgtggcgtactacaggccgccgaccaggaccgccgccgccgccttcaccgcggccaccggcttccgccagagcaagaaggcccgcgtcgagctccccgacgacgaggaggattacctcatcgtccctgatcttggttgaatcttgaagaggagttcgttccagaggagaagatcctcctcctgtgttcttgggttttgccatgtccttgtgttttctgcttgtatgctagcttttgtgtttaacgttagtcctgctcaactgtgacatatttgagccactctgcttccgtcccatgccatcagtgatcaatctgatataagtttttctgaaaatgagctccaggctctgctcttatgtttaatcttccgagattaccagtacagaaagagattaccagtac

SEQ ID NO: 40 - DNA, 1920 bp, Arabidopsis thaliana
gtttcttcctttggcatcgacgaaagtctgaaaactcttttctctccacctctttctctcttaccccaaacacaaaatctcctctttaatggatatatcgcctctccgatctcattcttcctcgtttttatctgccaaactcttattgctcttcttcttttgtagttttcgtgcttcttcgatttcttcttcttcagttgtttcccatcgtcgtaatccttctagctttcggtttctttgataattccctttgaattcgtttttcttcttctttcaatttccgcaaataatcagccgccgataagataatcatggggaggaaatctcagcgtaagaacgcgacaatgtttgatagtgatgatgatacaagtagtgtaagctcttcctccaccatgccatctgagagattgttgaatcctggtatggatgaagttactgttctcaaggatgctttgttagatcaatcccttgatgctctctatgagaaaagagagcaagctttggccaccattgttgacgcatttaacagcgacttgcagtatgagtttgttgaaaagaagtttgccactttattgcaccagtgtttacactgcaccaagaaagggtctactaaggagacttcattagcaactcatgtcattgggttgctagcgttaactgttggactcggggatcatgcacaagaggttttggaagaatctgtcactcctctgtctcaagcccttaaatctggtcgtgaaatcttgaaaataacttcgatacttgagtgtttagcagtcataaccttcgttggcgggaatgatccagagcaaaccgagaaatctatgcagattatctggcaaatgatccaccccaaactagggtctaatgttgtggcaactaaaccttcacctgctgtaataagtgctgttgtatcttcctgggcttttctgctcacaacagttgatcggtggactctaggtcctaaaatttttcaagagactgtaacttatctctctacattgttggaaaaggatgaccgatctgtacgtatagctgctggtgaagcgcttgcagtaatatatgagttgggaactctagagaagttcgctgccgaagtcaaagggtctgctaatggatcagtgaaagaaggaggtgtctctcaggaagcattgatgcacatgcatggcttgaaagctaaagtcactaaacaagttagagagctctctgtagaggcaggtggtaaaggttctgctaagaaagatctcaacacccaacgaaatttgttcaaagatcttgttgaatttcttgaggatggatatgctcctgaaacctcaacaaaagtcggaggggactatttacagacgtcaacgtggtatcagatgatacagttgaattatttgaagcatttcctagggggtggctttattaagcatatgcaggagaatgaattccttcatgatgtatttagtttcactccaaagaagattggtggaggaaagttgtctaatgacgaaaagaggttgtttaaatcaccaaactcagctcttaacaaagcaagaacgcagttcctggccaagcaaaggatgttagctaagaatatgaacgttgggcattacgcagctacagcaatggaggaagaatgatggctctacaattgatttttgaagaatgatggcacactcatctgctgcttttggaaaatgttgttgttccattagtacactttttcttgtttcatgtttttgatttgataattggttccaatattataaccaactcttagaaatgtcttttcatttataacaattttcgaccgttgagtgtaattcctatgattcaacacttgttgtttctgttaagagtgccattgaccaattgtattttgagctgagactcggaattgtcactgaaaatttgtcagtgtattggtgacagaca

SEQ ID NO: 41 - DNA, 1919 bp, Arabidopsis thaliana
gtttcttcctttggcatcgacgaaagtctgaaaactcttttctctccacctctttctctcttaccccaaacacaaaatctcctctttaatggatatatcgcctctccgatctcattcttcctcgtttttatctgccaaactcttattgctcttcttcttttgtagttttcgtgcttcttcgatttcttcttcttcagttgtttcccatcgtcgtaatccttctagctttcggtttctttgataattccctttgaattcgtttttcttcttctttcaatttccgcaaataatcagccgccgataagataatcatggggaggaaatctcagcgtaagaacgcgacaatgtttgatagtgatgatgatacaagtagtgtaagctcttcctccaccatgccatctgagagattgttgaatcctggtatggatgaagttactgttctcaaggatgctttgttagatcaatcccttgatgctctctatgagaaaagagagcaagctttggccaccattgttgacgcatttaacagcgacttgcagtatgagtttgttgaaaagaagtttgccactttattgcaccagtgtttacactgcaccaagaaagggtctactaaggagacttcattagcaactcatgtcattgggttgctagcgttaactgttggactcggggatcatgcacaagaggttttggaagaatctgtcactcctctgtctcaagcccttaaatctggtcgtgaaatcttgaaaataacttcgatacttgagtgtttagcagtcataaccttcgttggcgggaatgatccagagcaaaccgagaaatctatgcagattatctggcaaatgatccaccccaaactagggtctaatgttgtggcaactaaaccttcacctgctgtaataagtgctgttgtatcttcctgggcttttctgctcacaacagttgatcggtggactctaggtcctaaaatttttcaagagactgtaacttatctctctacattgttggaaaaggatgaccgatctgtacgtatagctgctggtgaagcgcttgcagtaatatatgagttgggaactctagagaagttcgctgccgaagtcaaagggtctgctaatggatcagtgaaagaaggaggtgtctctcaggaagcattgatgcacatgcatggcttgaaagctaaagtcactaaacaagttagagagctctctgtagaggcaggtggtaaaggttctgctaagaaagatctcaacacccaacgaaatttgttcaaagatcttgttgaatttcttgaggatggatatgctcctgaaacctcaacaaaagtcggaggggactatttacagacgtcaacgtggtatcagatgatacagttgaattatttgaagcatttcctagggggtggctttattaagcatatgcaggagaatgaattccttcatgatgtatttagtttcactccaaagaagattggtggaggaaagttgtctaatgacgaaaagaggttgtttaaatcaccaaactcagctcttaacaaagcaagaacgcagttcctggccaagcaaaggatgttagctaagaatatgaacgttgggcattacgcagctacagcaatggaggaagaatgatggctctacaattgatttttgaagaatgatggcacactcatctgctgcttttggaaaatgttgttgttccattagtacactttttcttgtttcatgtttttgatttgataattggttccaatattataaccaactcttagaaatgtcttttcatttataacaattttcgaccgttgagtgtaattcctatgattcaacacttgttgtttctgttaagagtgccattgaccaattgtattttgagctgagactcggaattgtcactgaaaatttgtcagtgtattggtgacagac

SEQ ID NO: 42 - DNA, 1342 bp, Oryza sativa
ccaatcctcacatcgcagagcaatctcgaagagcaaacgacccgcaccaccggccacagacggagagttcgagagcagggaaatctgaaatttggagagaccaaagatggcagcgacgaacaagaagatcgtgctgaggaaccacgtgacggggttccccaaggagtccgacatggagctcgtcgccgcgacgggcgccgcgccgtccagggtgcccgagggcacggacggcgccgtcctcgtgaagaacctgtacctgtcctgcgacccctacatgcgcggccgcatgtccagccatgacggctcttacgtcgacgctttcgtcgtcggcgaggctatcaccggctatggcgtcgggaaggtggtggactcgagccacccggggttcaaagccggcgacctcgtgtggggaatgacgggatgggaggagtacagcctcatcaaggatcccagcagggccctcttcgccatccgccatcccgacctgccgctctcctactacaccggcctcctcggcatggcgggcttcacggcgtacgtcgggttccacgagatatgcgcgccaagggaaggcgagagggtgtacgtctccgccgcgtcgggcgccgtggggcagctggtgggacagttcgccaagctcatgggctgctacgtcgtcgggagcgccggctccgacgacaaggtgaggctgctcagggagaagttcggcttcgacgacgccttcaactacaagaaggagagtgacctgagcgcggccctgaagcggtgcttcccggaagggatcgacatctacttcgaaaacgtgggcggcgcgatgctggacgccgtgctgctcaacatgcgggtgcgcggccgcgtcgcggcctgcgggatgatctcgcagtacaacctggagcaccccgaccccgtccacaacctgacggccatcgtcacgaagcggctccggatcgaagggttcatcgtgtccgaccactacgccaggtacagggagtacgaggagaaggccgcgcggtatgtgaaggaggggaagatcgcgtacgtggaggacgtcgccgaagggctggagaacgcgccggccgcgctcatcgggctcttctccggccgcaacgtcggcaagcaggtggtcgtcgtcgccagggagtaaccgcgagatgtgtagttaaacgtgtagcggtatggttacacttcactagtgctgtgcattgtcctgatggctgatgctgtgtttagatgtgtcaagcttagctgaatgcgttggattttgtatcttgaacatcaataacggtgtattttaacaagtgtttagttgttttgaatacacagtaagacaagattaaagtga

SEQ ID NO: 43 - DNA, 1347 bp, Oryza sativa
ccaacccaatcctcacatcgcagagcaatctcgaagagcaaacgacccgcaccaccggccacagacggagagttcgagagcagggaaatctgaaatttggagagaccaaagatggcagcgacgaacaagaagatcgtgctgaggaaccacgtgacggggttccccaaggagtccgacatggagctcgtcgccgcgacgggcgccgcgccgtccagggtgcccgagggcacggacggcgccgtcctcgtgaagaacctgtacctgtcctgcgacccctacatgcgcggccgcatgtccagccatgacggctcttacgtcgacgctttcgtcgtcggcgaggctatcaccggctatggcgtcgggaaggtggtggactcgagccacccggggttcaaagccggcgacctcgtgtggggaatgacgggatgggaggagtacagcctcatcaaggatcccagcagggccctcttcgccatccgccatcccgacctgccgctctcctactacaccggcctcctcggcatggcgggcttcacggcgtacgtcgggttccacgagatatgcgcgccaagggaaggcgagagggtgtacgtctccgccgcgtcgggcgccgtggggcagctggtgggacagttcgccaagctcatgggctgctacgtcgtcgggagcgccggctccgacgacaaggtgaggctgctcagggagaagttcggcttcgacgacgccttcaactacaagaaggagagtgacctgagcgcggccctgaagcggtgcttcccggaagggatcgacatctacttcgaaaacgtgggcggcgcgatgctggacgccgtgctgctcaacatgcgggtgcgcggccgcgtcgcggcctgcgggatgatctcgcagtacaacctggagcaccccgaccccgtccacaacctgacggccatcgtcacgaagcggctccggatcgaagggttcatcgtgtccgaccactacgccaggtacagggagtacgaggagaaggccgcgcggtatgtgaaggaggggaagatcgcgtacgtggaggacgtcgccgaagggctggagaacgcgccggccgcgctcatcgggctcttctccggccgcaacgtcggcaagcaggtggtcgtcgtcgccagggagtaaccgcgagatgtgtagttaaacgtgtagcggtatggttacacttcactagtgctgtgcattgtcctgatggctgatgctgtgtttagatgtgtcaagcttagctgaatgcgttggattttgtatcttgaacatcaataacggtgtattttaacaagtgtttagttgttttgaatacacagtaagacaagattaaagtga

SEQ ID NO: 44 - DNA, 1906 bp, Arabidopsis thaliana
cgaacgaagattctcttgctcgaacaaaaaaattctctccgcgatacttacaaagcacaagtgagctagctttgagaaagattcaatttttgagccttaagattgtgatgggagttgtgtctatttcaagttcagctgcaagatctccactcgggttgggcaacgatcttttgacacatcggtcttcacttaaaaagccatccattgttgcttttaaagccgatgattccagcaattcagctttgatcattcctcctcgtgagcaagttttgattcctgctgaaaagcataatgagaagaagagagaagtaacgaggagaaagccttgtaaaaccccgaaaaaaccgctttccttggaacataattcggctccttcgtgttcgttaggagtagattacaatgaagctgctgcaagacttgaaagcatatacaagcttagtcctgcaacaaccacattagtcgaggatgatgttgaagatggcggctctaaagccaaagtttcacggaggagaaaaaggaaagaaagtggtgaggagaagaaagtggttgtgaggaataatgtgaagaaggaaaaacgtatgagtcttgataaacggattgctttgaagagaaacgttcaagagaaaccagtcgttgcttctgttgataagaaagtaacaaagaggcagcaagaagaggagaagatcgagaggcttgtgcgggactattcagcttctaatgatatagtgagcttggactggaaaaaaatgaagatacctcctgttctttcttctactgaacatgcttggttgttcaagttgatgcaacctatgaaggctcttcttgaagtgaaagatgtattgcaaaagagcttgggaagagagcctagggaagctgaaatagccggggagatcaatatgactgcgggtgaagtaaaaaagaaaatcgaaataggtagagctgcaagaaacaaacttattaagcacaatctccggcttgtcttgtttgttatgaacaaatactttcatgagtttaccaacggaccaaaattccaagacctttgtcaagcgggtatgagagggcttatcacagcaattgaccgctttgagccgaaaaggaagtttcgtctttcgacttatggtttgttttggattagacatgccatcatacggtcaatgacaacttcaaacttcactcgtgtcccatttggacttgaatcggttagagtggagatatataaagcaaagactgagctatggtttgagatgggaagacctccaacggaggacgaggtagttgagagactcaagataacacctgagagataccgtgaagtattgagggctgcaaaaccggttttgtcactaaattcaaaacattcggttactcaagaagaattcatcaacggaatcacagatgttgatggtgttggagctaataacagcagacagcctgctcttctcaggctcgctctcgacgatgtgctcgattcattgaagccgaaagagagtctggttattcgacagaggtacggtcttgatggaaaaggcgacaggactctaggagagatagctggaaatctcaacatctctagagaaatggttaggaaacatgaagtcaaggccttgatgaagcttaagcatcaggccagagttgattaccttcgtcaatacatcgtctaaaaccaaaccgaaccgaactgagccgcctcactcaaccatttgtgcatacttggtatgatttcccgactttacgagatacttcacaccctcttataaccgttgtatagttgtgtatgtaatagcggagttacttatagctgcgttaaatcgatcagtgaatcgcaatcgttgtattatatcattagtatactcatactgaaaagttatacatgtaaagtttgagatatgttatgcattatcttcac

SEQ ID NO: 45 - DNA, 1957 bp, Arabidopsis thaliana
cgaacgaagattctcttgctcgaacaaaaaaattctctccgcgatacttacaaagcacaagtgagctagctttgagaaagattcaatttttgagccttaagattgtgatgggagttgtgtctatttcaagttcagctgcaagatctccactcgggttgggcaacgatcttttgacacatcggtcttcacttaaaaagccatccattgttgcttttaaagccgatgattccagcaattcagctttgatcattcctcctcgtgagcaagttttgattcctgctgaaaagcataatgagaagaagagagaagtaacgaggagaaagccttgtaaaaccccgaaaaaaccgctttccttggaacataattcggctccttcgtgttcgttaggagtagattacaatgaagctgctgcaagacttgaaagcatatacaagcttagtcctgcaacaaccacattagtcgaggatgatgttgaagatggcggctctaaagccaaagtttcacggaggagaaaaaggaaagaaagtggtgaggagaagaaagtggttgtgaggaataatgtgaagaaggaaaaacgtatgagtcttgataaacggattgctttgaagagaaacgttcaagagaaaccagtcgttgcttctgttgataagaaagtaacaaagaggcagcaagaagaggagaagatcgagaggcttgtgcgggactattcagcttctaatgatatagtgagcttggactggaaaaaaatgaagatacctcctgttctttcttctactgaacatgcttggttgttcaagttgatgcaacctatgaaggctcttcttgaagtgaaagatgtattgcaaaagagcttgggaagagagcctagggaagctgaaatagccggggagatcaatatgactgcgggtgaagtaaaaaagaaaatcgaaataggtagagctgcaagaaacaaacttattaagcacaatctccggcttgtcttgtttgttatgaacaaatactttcatgagtttaccaacggaccaaaattccaagacctttgtcaagcgggtatgagagggcttatcacagcaattgaccgctttgagccgaaaaggaagtttcgtctttcgacttatggtttgttttggattagacatgccatcatacggtcaatgacaacttcaaacttcactcgtgtcccatttggacttgaatcggttagagtggagatatataaagcaaagactgagctatggtttgagatgggaagacctccaacggaggacgaggtagttgagagactcaagataacacctgagagataccgtgaagtattgagggctgcaaaaccggttttgtcactaaattcaaaacattcggttactcaagaagaattcatcaacggaatcacagatgttgatggtgttggagctaataacagcagacagcctgctcttctcaggctcgctctcgacgatgtgctcgattcattgaagccgaaagagagtctggttattcgacagaggtacggtcttgatggaaaaggcgacaggactctaggagagatagctggaaatctcaacatctctagagaaatggttaggaaacatgaagtcaaggccttgatgaagcttaagcatcaggccagagttgattaccttcgtcaatacatcgtctaaaaccaaaccgaaccgaactgagccgcctcactcaaccatttgtgcatacttggtatgatttcccgactttacgagatacttcacaccctcttataaccgttgtatagttgtgtatgtaatagcggagttacttatagctgcgttaaatcgatcagtgaatcgcaatcgttgtattatatcattagtatactcatactgaaaagttatacatgtaaagtttgagatatgttatgcattatcttcacaaaattgaacgtagtgattcctaagaaaatggaatcaatagacgggtttgt

SEQ ID NO: 46 - DNA, 1159 bp, Oryza sativa
aggaaagcccgcgacgagaataccaaaccaaatccaccaagtccaaggggatctctctctcgcctcgcctcgcctcgcctcgtctagttgagcagccgcgacgagcacggcggcgacgacgacctccgccgcgacgatggccgcgcgcctcctcctcctcgtacttttcgccgtcgtggcagcgcgcgtaggcgcagcggcggcctatcagcccggatctgctgaggggcacacgatcgcgggccgcatcaagatcgatgctgcaagtgcaattgcaaagggctttggtcttccagccaagacatcaaacacaaaagtgatacttaacggtggtcagagggttacatttgccaggccagatggctactttgcattccacaatgtgccagctggtactcatttaattgaggtctcctcattgggctacttattttcaccagttcgggtagacatcagtgccaggaatcctgggcacattcaagcagcattgactgaaaacagaagagttctaaatgagcttgtgttggaacctctcagagaagagcaatactacgagaaaagggagcctttctccattatgtcacttttgaagagccctatgggtatgatgcttggttttatggtcataatggtcttcgttatgcccaaaatgatggagaacatagatcccgaggagataaagcaagctcaagaacaaatgaggaactcccctgttccatccttctctggcctattagcaagagcaaacagctagacatactacacggggatactgcatggtttaagttaagtttatgatgggatgaagagcagtactgaacaccacacttgaatagaatctttccctagcacaaggtggaaactctttctccatttttattgtactttaagatgtaataggtttgtgggggtagaaccttctgaatctaactgaagtagcgatgcattattgaattattatagcccagactgagttaagtgtgttgaattttggatgttcgtatatttcacgccttgttgaatcaactatagctatactcatacttgatgttgacctgctattagtcacatgacgttatgatgtactctcgacttgataaacattaggccatgtccatatgcaggtgactcaaattgcttgcttgctcttcacttgatt

SEQ ID NO: 47 - DNA, 987 bp, Oryza sativa
aggaaagcccgcgacgagaataccaaaccaaatccaccaagtccaaggggatctctctctcgcctcgcctcgcctcgcctcgtctagttgagcagccgcgacgagcacggcggcgacgacgacctccgccgcgacgatggccgcgcgcctcctcctcctcgtacttttcgccgtcgtggcagcgcgcgtaggcgcagcggcggcctatcagcccggatctgctgaggggcacacgatcgcgggccgcatcaagatcgatgctgcaagtgcaattgcaaagggctttggtcttccagccaagacatcaaacacaaaagtgatacttaacggtggtcagagggttacatttgccaggccagatggctactttgcattccacaatgtgccagctggtactcatttaattgaggtctcctcattgggctacttattttcaccagttcgggtagacatcagtgccaggaatcctgggcacattcaagcagcattgactgaaaacagaagagttctaaatgagcttgtgttggaacctctcagagaagagcaatactacgagaaaagggagcctttctccattatgtcacttttgaagagccctatgggtatgatgcttggttttatggtcataatggtcttcgttatgcccaaaatgatggagaacatagatcccgaggagataaagcaagctcaagaacaaatgaggaactcccctgttccatccttctctggcctattagcaagagcaaacagctagacatactacacggggatactgcatggtttaagttaagtttatgatgggatgaagagcagtactgaacaccacacttgaatagaatctttccctagcacaaggtggaaactctttctccatttttattgtactttaagatgtaataggtttgtgggggtagaaccttctgaatctaactgaagtagcgatgcattattgaattattatagcccagactgagttaagtgtgttga

SEQ ID NO: 48 - DNA, 3054 bp, Arabidopsis thaliana
aaggatataaaaggaaattcgaaaccggcgaattcggagaaaaaaaaaaaaaaaccttgcgtgtttatccgcaagggattttgattttggaaaaagaaagagagagggatctgaagcatggagaagaagaaggtatggttttggggtgtgaaagacgacggcgaaggaggcggaggcagaggaggaggaagaaccaaagatgcggaggatgatgttgctgaccatttatctcgcgacgggacgatgagtcagtatagccttagcaaaggccttcttccttctcttggagccaacaatcgttcctctcgtgacgtcattctccctcgcttcatcgtctctccttttgatcctcgttacagagcgtgggagacgtttttggtgtttttggtgctctacacagcttgggcatcaccttttgaatttgggtttctgcaaaagccaagaccacctctcagtattctcgataacattgtcaacgggtttttcgctgttgatatagtcttgacattctttgttgccttcttggacaaggtaacttatcttcttgtcgatgatccaaagagaatagcttggagatatgcgtcgacttggctgattttcgacgtggtttccacatttccttacgaaatttttgggagcttgcttcatgagagtattcagggatatggtattttcagtatgctacgtttatggcgtcttcgtagggtcagtaattgttttgccaggttagagaaagacaggaaatacagttacttttgggttcgctgctcgaagcttctccttgttactctttttgtgattcattgtggtgcttgtttcctctattccattgctgcacattatccagatccatccaagacgtttatggcattaaccgatgaaaattggaaagagtctcctattgcagtgcggtataacacggcaatgtattggtccataactactttctccacaactggttatggtgatatacatggtgttaactcaagagagatgactttcattcttttctacatggtttttaatcttggactgtcagcatatataattggtaatatgaccaacttggtggttcatgtgaccggccgcaccagaaaatttagagataccatccaagccgcatcagggtttggtcagaggaacaatctgccagtgcggttacaagatcagatggttgctcatttgtgtttgaggtacagaactgattcagaaggcttacagcagcaagaaataatcgattctcttcccaaagctattcggtccagcatatcacattatctgttctatgaagttgttgacaaaatttacttgttccatggaatatccaatgatcttcttttccagttggtcacggaaatgaaagcagagtattttcctcccaaagaagatgtgattttgcaaaatgaagccccaacagatttctacatattggtgaccggagctgttgacataattgcacgtgtaaatggagtggagcaggtagttagtgaagcacagagaggacatgtttttggtgaagttggggtactatgttacagaccgcagctgtttactgttcgtaccaagcgattgagtcagttgcttcgtctgaaccgtacagtactcttaaatcttgttcaggcaaatgtaggagatggagcaataatcatgaataatcttcttcagcatttaaaagactcagaagatccagtgatgaaaggcgttttggctgatacagaacacatgttggctcaagggaaaatggatttacctctcagcttgtgctttgctgcagccagaggagatgatttattgctgcatcagttactaagacgaggctcaagccctaatgaaatggataaggacgggcgaactgcgctgcatatagcagcatcaaagggaagccattattgcgtcgttttacttctcgaacatggagcagatcctaacattagagattccgaaggcaatgtacccttgtgggaagcaatcataggaagacatagagaaattgctaaactccttgcagagaatggagcaaagctaagcttagactcagtgagctatttctctggcttagccgtggagaaaaactgcttagacgcactcaaagacatcatcaaatatggcggcgacgtcacactccctgatggaaacggaaccacagctttacacagagcagtgtcagaaggacacttggagattgtgaagttcttactagaccaaggtgctgacttggactggccggattcttacggatggactcctcgtggtcttgccgatcatcaagggaatgaagaaatcaaaaccttgtttcataatcacaggcctgtggagaaaaaaccgaaacctatccctggaatacctcagagtcctgtgacagggaagccattaatgaagtatagcagtgagcctacaatgcattcaggagaactcgtcttagacgggggtcaggttgttgtttctcagaaacggaaactcaataacttcagaaactcgctcttcggaatcatttcagctgcaaatagcgctgatgatggaggagaagttccaagaagtccagcggttcctggaggaggaggtagtatgatttatccggagagagtgacgataagttcgccggaaaacggtgaaactggtggaaaagttgttttgttaccaaattctatggaagagctattgaaaattggtgaaaataagatgggattcgtcccaactaaagtacttacgagagaaggagctgaaattgacgacatcactcttatcagagatggcgattttctccttctatcaagggatccttgattcacacgcaactctctttcgattttgagtaatgaaaactatttgtcttaacgcaaactcccaaaccaccacagtcaagctttatggtggtgatatgatgctaatattaggggaaaccgtaagccccaatcaactccgggattgaaatatcttttaggttttttttttttgcttttgtgtatatattcactgcttactatttttcacatgtatatatatatatatcctgttgactattttctgttaaaagaactctctaacaacctcatg

SEQ ID NO: 49 - DNA, 3091 bp, Arabidopsis thaliana
cacaacaaaaaagaaagaaacaaacgtaacagaaaaaaggatataaaaggaaattcgaaaccggcgaattcggagaaaaaaaaaaaaaaaccttgcgtgtttatccgcaagggattttgattttggaaaaagaaagagagagggatctgaagcatggagaagaagaaggtatggttttggggtgtgaaagacgacggcgaaggaggcggaggcagaggaggaggaagaaccaaagatgcggaggatgatgttgctgaccatttatctcgcgacgggacgatgagtcagtatagccttagcaaaggccttcttccttctcttggagccaacaatcgttcctctcgtgacgtcattctccctcgcttcatcgtctctccttttgatcctcgttacagagcgtgggagacgtttttggtgtttttggtgctctacacagcttgggcatcaccttttgaatttgggtttctgcaaaagccaagaccacctctcagtattctcgataacattgtcaacgggtttttcgctgttgatatagtcttgacattctttgttgccttcttggacaaggtaacttatcttcttgtcgatgatccaaagagaatagcttggagatatgcgtcgacttggctgattttcgacgtggtttccacatttccttacgaaatttttgggagcttgcttcatgagagtattcagggatatggtattttcagtatgctacgtttatggcgtcttcgtagggtcagtaattgttttgccaggttagagaaagacaggaaatacagttacttttgggttcgctgctcgaagcttctccttgttactctttttgtgattcattgtggtgcttgtttcctctattccattgctgcacattatccagatccatccaagacgtttatggcattaaccgatgaaaattggaaagagtctcctattgcagtgcggtataacacggcaatgtattggtccataactactttctccacaactggttatggtgatatacatggtgttaactcaagagagatgactttcattcttttctacatggtttttaatcttggactgtcagcatatataattggtaatatgaccaacttggtggttcatgtgaccggccgcaccagaaaatttagagataccatccaagccgcatcagggtttggtcagaggaacaatctgccagtgcggttacaagatcagatggttgctcatttgtgtttgaggtacagaactgattcagaaggcttacagcagcaagaaataatcgattctcttcccaaagctattcggtccagcatatcacattatctgttctatgaagttgttgacaaaatttacttgttccatggaatatccaatgatcttcttttccagttggtcacggaaatgaaagcagagtattttcctcccaaagaagatgtgattttgcaaaatgaagccccaacagatttctacatattggtgaccggagctgttgacataattgcacgtgtaaatggagtggagcaggcaattagtgaagcacagagaggacatgtttttggtgaagttggggtactatgttacagaccgcagctgtttactgttcgtaccaagcgattgagtcagttgcttcgtctgaaccgtacagtactcttaaatcttgttcaggcaaatgtaggagatggagcaataatcatgaataatcttcttcagcatttaaaagactcagaagatccagtgatgaaaggcgttttggctgatacagaacacatgttggctcaagggaaaatggatttacctctcagcttgtgctttgctgcagccagaggagatgatttattgctgcatcagttactaagacgaggctcaagccctaatgaaatggataaggacgggcgaactgcgctgcatatagcagcatcaaagggaagccattattgcgtcgttttacttctcgaacatggagcagatcctaacattagagattccgaaggcaatgtacccttgtgggaagcaatcataggaagacatagagaaattgctaaactccttgcagagaatggagcaaagctaagcttagactcagtgagctatttctctggcttagccgtggagaaaaactgcttagacgcactcaaagacatcatcaaatatggcggcgacgtcacactccctgatggaaacggaaccacagctttacacagagcagtgtcagaaggacacttggagattgtgaagttcttactagaccaaggtgctgacttggactggccggattcttacggatggactcctcgtggtcttgccgatcatcaagggaatgaagaaatcaaaaccttgtttcataatcacaggcctgtggagaaaaaaccgaaacctatccctggaatacctcagagtcctgtgacagggaagccattaatgaagtatagcagtgagcctacaatgcattcaggagaactcgtcttagacgggggtcaggttgttgtttctcagaaacggaaactcaataacttcagaaactcgctcttcggaatcatttcagctgcaaatagcgctgatgatggaggagaagttccaagaagtccagcggttcctggaggaggaggtagtatgatttatccggagagagtgacgataagttcgccggaaaacggtgaaactggtggaaaagttgttttgttaccaaattctatggaagagctattgaaaattggtgaaaataagatgggattcgtcccaactaaagtacttacgagagaaggagctgaaattgacgacatcactcttatcagagatggcgattttctccttctatcaagggatccttgattcacacgcaactctctttcgattttgagtaatgaaaactatttgtcttaacgcaaactcgcaaaccaccacagtcaagctttatggtggtgatatgatgctaatattaggggaaaccgtaagccccaatcaactccgggattgaaatatcttttaggttttttttttttgcttttgtgtatatattcactgcttactatttttcacatgtatatatatatatatcctgttgactattttctgttaaaagaactctctaacaacctcatga

SEQ ID NO: 50 - DNA, 2799 bp, Arabidopsis thaliana
ataaattaaaaacaaaaaaacaaaaaacgtctctttgtatctcctcaaaagccgaaacaaaacctctctttctcacaagtaagcaacttcaaaatctggttaacccaaattacaaaaaaaacaaaaaaataaaaagtcgctctctttcttcttaaaaatctcaactttgtcgtccaaaactccaaatccagaaacccatacgcaaatatccttctacgtgtttgctcctttcacgtttttctcgaatcttctcgcatttaccaatcaaacagattctaaagttccaaactttttctttctttctcaaaccattctctgtttctcaactcttcactttccagtggtaagatttgaatcatgggtttctcaaattcttaacttttcacaaaagcccaccatggaaatcgaatcaggaagttatcaaaacgccaagaaggaatcatggagaacagtattaacattagcgtatcaaagcttaggtgttgtatacggagacttgagtatttcacctctatatgtatacaaaagcacattcgctgaagacattcatcactctgaatccaacgaagagatctttggtgttttgtctttcatcttttggacaatcactcttgtccctcttcttaaatacgttttcatagttcttagagcagatgataatggtgaaggaggcacttttgctctttactcgcttttatgtcgacacgcacgagtcaactcgttaccgagttgtcaattggctgatgagcagcttattgagtataagactgattcaattggttcgtcttcgatgcctcaatctggttttgcagcgagtttgaaatctactcttgagaaacatggagttttgcagaagattttgcttgttcttgctttgattgggacttgtatggttattggtgatggtgttctcacgcctgctatttcagttttttctgcagtatctggtgttgagctttcaatgtctaaggagcatcacaagtatatagaactccctgctgcttgtgtaattctgataggtttgtttgcacttcagcactacggtacacacagggtcgggttcttgttcgccccggtgattctgttgtggctaatgtgtatcagcgccatcggtgtttacaacattttccattggaacccgcatgtgtaccaagcactttctccttattacatgtacaagttcctcaagaaaactcaaagtagaggctggatgtctcttggtggtatcttactctgcattacaggttccgaagcaatgtttgcggatctaggacatttttctcaactctcaatcaagattgcttttacgtcacttgtttacccgtccttgatactcgcctacatgggacaagcagcttatctctctcagcatcatattattgaaagcgaatacaatatcgggttttatgtatcggtaccagaaagattaagatggccagttcttgtgatcgctatactcgctgctgtagttggaagtcaagcaatcatcacaggaacattctcgatcatcaaacaatgctctgcattgggatgcttccctaaagtgaagattgttcatacgtcatccaaaatccacggtcagatttacatccctgagatcaattggatcttgatggttctctgtttagctgtcaccattggcttcagagacaccaagcggttgggtaatgcttcaggattggcggttataactgttatgctggtgacaacatgcttaatgtcactagtgattgtactttgctggcacaagagtgtcatctttgcaatcgtattcgttgtattcttcggcacaatcgaatctctctacttctctgcttccttaatcaaattcctcgaaggcgcatgggttccaatcgccctcgctttttgcttccttctcgcgatgtgtacttggcactacggaacactcaagcgctatgagtacgatgtgcaaaacaaagtctcggtcaactggctcctcagtcttagtcaaaccctcgggatcgcacgtgtccgtggccttggactcatccacaccgagctcgtctctggtgtccccgcgatattctctcattttgtcaccaacctccctgccttccaccaggttctcgtcttcctctgtgtcaaatctgttccggttccgcatgttcgtcctcaggaacggtttctagtaggacgcatcgggccaaaagagttccgcatataccgttgcattgtccggttcgggtaccgtgatgtccacaaagacgatttcgagtttgaaggcgatcttgtatgtagcattgccgagtttatccgtactgaagctgaaaccgccgccaccgctgcagagaccaacggagaggatgatgatagaatgtcagtagtaggtacttgttccacatacatgcaaggaattgaggatcactacgaaagcgatattgatgaccctgataaaccagggacgtcagagattcgatcaccaaaaccaaagaaaaagagtaagagtaaggtcaaaaagagagtgaggtttgttgtcccggagactccaaagatagaaaaggaaactaggcaagagttaatggagctaacagaggcacgagagggaggcgtggcttatataatgggaaacgcttatatgaaagcgaagccaggatcaggattactcaagagactcgccattaacattggctacgagtttcttaggaggaacactagaggtcctagaaacatgcttacctcgcctcacgcttctactttagaagtcggtatgatctataatgtctaaaggggggtattttggtctttttgtaaatgcttttgttgtggtttaatttgcca

SEQ ID NO: 51 - DNA, 2950 bp, Arabidopsis thaliana
ataaattaaaaacaaaaaaacaaaaaacgtctctttgtatctcctcaaaagccgaaacaaaacctctctttctcacaagtaagcaacttcaaaatctggttaacccaaattacaaaaaaaacaaaaaaataaaaagtcgctctctttcttcttaaaaatctcaactttgtcgtccaaaactccaaatccagaaacccatacgcaaatatccttctacgtgtttgctcctttcacgtttttctcgaatcttctcgcatttaccaatcaaacagattctaaagttccaaactttttctttctttctcaaaccattctctgtttctcaactcttcactttccagtggtaagatttgaatcatgggtttctcaaattcttaacttttcacaaaagcccaccatggaaatcgaatcaggaagttatcaaaacgccaagaaggaatcatggagaacagtattaacattagcgtatcaaagcttaggtgttgtatacggagacttgagtatttcacctctatatgtatacaaaagcacattcgctgaagacattcatcactctgaatccaacgaagagatctttggtgttttgtctttcatcttttggacaatcactcttgtccctcttcttaaatacgttttcatagttcttagagcagatgataatggtgaaggaggcacttttgctctttactcgcttttatgtcgacacgcacgagtcaactcgttaccgagttgtcaattggctgatgagcagcttattgagtataagactgattcaattggttcgtcttcgatgcctcaatctggttttgcagcgagtttgaaatctactcttgagaaacatggagttttgcagaagattttgcttgttcttgctttgattgggacttgtatggttattggtgatggtgttctcacgcctgctatttcagttttttctgcagtatctggtgttgagctttcaatgtctaaggagcatcacaagtatatagaactccctgctgcttgtgtaattctgataggtttgtttgcacttcagcactacggtacacacagggtcgggttcttgttcgccccggtgattctgttgtggctaatgtgtatcagcgccatcggtgtttacaacattttccattggaacccgcatgtgtaccaagcactttctccttattacatgtacaagttcctcaagaaaactcaaagtagaggctggatgtctcttggtggtatcttactctgcattacaggttccgaagcaatgtttgcggatctaggacatttttctcaactctcaatcaagattgcttttacgtcacttgtttacccgtccttgatactcgcctacatgggacaagcagcttatctctctcagcatcatattattgaaagcgaatacaatatcgggttttatgtatcggtaccagaaagattaagatggccagttcttgtgatcgctatactcgctgctgtagttggaagtcaagcaatcatcacaggaacattctcgatcatcaaacaatgctctgcattgggatgcttccctaaagtgaagattgttcatacgtcatccaaaatccacggtcagatttacatccctgagatcaattggatcttgatggttctctgtttagctgtcaccattggcttcagagacaccaagcggttgggtaatgcttcaggattggcggttataactgttatgctggtgacaacatgcttaatgtcactagtgattgtactttgctggcacaagagtgtcatctttgcaatcgtattcgttgtattcttcggcacaatcgaatctctctacttctctgcttccttaatcaaattcctcgaaggcgcatgggttccaatcgccctcgctttttgcttccttctcgcgatgtgtacttggcactacggaacactcaagcgctatgagtacgatgtgcaaaacaaagtctcggtcaactggctcctcagtcttagtcaaaccctcgggatcgcacgtgtccgtggccttggactcatccacaccgagctcgtctctggtgtccccgcgatattctctcattttgtcaccaacctccctgccttccaccaggttctcgtcttcctctgtgtcaaatctgttccggttccgcatgttcgtcctcaggaacggtttctagtaggacgcatcgggccaaaagagttccgcatataccgttgcattgtccggttcgggtaccgtgatgtccacaaagacgatttcgagtttgaaggcgatcttgtatgtagcattgccgagtttatccgtactgaagctgaaaccgccgccaccgctgcagagaccaacggagaggatgatgatagaatgtcagtagtaggtacttgttccacatacatgcaaggaattgaggatcactacgaaagcgatattgatgaccctgataaaccagggacgtcagagattcgatcaccaaaaccaaagaaaaagagtaagagtaaggtcaaaaagagagtgaggtttgttgtcccggagactccaaagatagaaaaggaaactaggcaagagttaatggagctaacagaggcacgagagggaggcgtggcttatataatgggaaacgcttatatgaaagcgaagccaggatcaggattactcaagagactcgccattaacattggctacgagtttcttaggaggaacactagaggtcctagaaacatgcttacctcgcctcacgcttctactttagaagtcggtatgatctataatgtctaaaggggggtattttggtctttttgtaaatgcttttgttgtggtttaatttgccaaaaaaaaaaaaatgaattagatatagctaaagaaattttgttctgtggaggttttgctaaaggttgttagagtttatagctcaagaatcctcccttagagccaaatatagagttcaaacttgtgtacaaatgatatatgtgaatcatgttt

SEQ ID NO: 52 - DNA, 2455 bp, Glycine max
ggtatacggtgatattggtacatcaccactttatgtgtatgcaagcaccttcactaaaaaaattaacaacaatgatgacattcttggcgtcttgtctctcatcatctataccattgtgctcataccttttcttaaatatgtcttcatcgtattgtgggccaacgacaacggcaacggtggagcgtttgcactctattcgctaatctgtaggcatataaagatgagtttgattccaaatcaagaaccagaggacagggagctttctaactacaaacttgaaacaccgtctactgagtttaaacgagcccagaaactaaagcagaagcttgagggcagtcatgttgcgcgggttgtgcttattcttctagctatagtgggaacttccatggtcataggagacgggattcttacaccgtcaatctcagtcctttctgcggtaagtgggatcagtacatctttaggtcaagatgctgttgtggggatcactatagcaatcttggcagtcctattttatgtgcaacgatttggtacagataaagtggggttcgcattcgctccaataattttggtgtggtttttattcattggtggaattggcctttacaatttatttaaatatgacattggcgtattacgtgcttttaatccaaaatatatatatgattacttcaaacggaacggcaaggaaggatggatatcacttggtggagtctttttgtgcataacaggatccgaggccatgtttgctgacttgggtcactttaatgtacgatccattcaaattagcttttcttgcatcacatttcctgcaatagtggctgcatatattgggcaagcagcatttctacggaagttccctgagaaagtggccaatactttctatgatagtataccggatcccttatattggccaacatttgttgttgctgttgctgctgccattatagctagccaggcaatgatttcgggagcattctctattatatctcaggccctaagtctaggttgtttcccaagagttagggtagtgcacacttccattaaacatcarggtcaggtgtatattcctgaggtcaactacatgttcatgattgcatgtattgtggtctgtgctgccttcaagaccacagaaaagattwgccatgcatatgggatkgcagttattggtgatatgatgatcacaacaacwctagywtcgctwataatgcttgttttgtggaaaaagagtckgtggcgmgtgggtstgttctttttgggattyggyttcrttgagattgtttatttctcttctcaactaaccaagtttacagsaggagggtatcttccaatwgtatcagctatgttcttgacggcrgtgatgggaatctggcattatgtgcacaaagaaagatacatgtttgaattgaaaaacaaggtttcgagtgcgtatttgaatgaactggccaacaacccagacgtaaggagagtgcccggaataggacttctgtactcagagctagtacaaggcattcctcccatattccaacacttaatagacaacataccatctatccattcaattattgtgtttgtctccatcaaggcaattcctgttagtagagttgcatcagaggagcgctttttgtttcggcaggtggagccgagagattacagagtttttcgttgtgttgtgaggcatggttacaatgacgtgcttgaggatcctgcagagtttgagtcacacttgatacaaaatctcaaggcattcgttcaacatgagaactatatgctcgaggttgatggaactgaacacgcatcagctgagactgagatgatagcagcagtaggtaagggttcttccaacagaataatcccagatcaagctgcagcctcatccgactccattcgatcattgggggccagtgcgaccaagtcatcctctttcatttccccacccatccagggagctgaagacgaaatcaaattcatagacaaagcattggagaagggcgtcgtctatatgctagcagaagcagaggtagttgctcacccatcttcctccatcttgaataagattgttgtcaactatgtttatagcttcttcagaaagaactttagacaaggccagaattccatggcaatccaacgcaacagacttctcaaggttggaatgacttatgaaatatgacctcgatttccagtagtttcactgtccatacataaaaataaagaaatatgtactttgcttgaattttgtatcttttccaccaaatcatgcaagttataagttatgttcaagaaaaagccttcgctccaataagccttcaaaactttccaaaatataagcaatcccaatgcccaacatcatcggagtcggagctagacactttcacagaaagtgccaactttgaatcatttatgtgtattgatactttttttattttttaaactaaacaaagctcatttcattgcatta

SEQ ID NO: 53 - DNA, 2719 bp, Glycine max
tgagagtatatatatatataaaagtgctagctgaaggaagatgtctggagaagcagatcgaacgagcattgaggaagagatggacacaggaaaggagactgcagagaagaacctgaagctcaaagaccgaaaggtatcatgggcaaagctacgccgcgtagattctctcaatttagaagctggaagagtttctacggttgctcacaacccctaccagatgggttggaggacgacgctgatcttagcatttcaaagcataggggtggtatacggtgatattggtacatcaccactttatgtgtatgcaagcaccttcactaaaaaaattaacaacaatgatgacattcttggcgtcttgtctctcatcatctataccatcgtgctcatacctttgcttaaatatgtcttcatcgtattgtgggccaacgacaacggcaacggtggagcgtttgcactctattcgctaatctgtaggcatataaagatgagtttgattccaaatcaagaaccagaggacagggagctttctaactacaaacttgaaacaccgtctactgagtttaaacgagcccagaaactaaagcagaagcttgagggcagtcatgttgcgcgggttgtgcttattcttctagctatagtgggaacttccatggtcataggagacgggattcttacaccgtcaatctcagtcctttctgcggtcagtgggatcagtacatctttaggtcaagatgctgttgtggggatcactatagcaatcttggcagtcctattttatgtgcaacgatttggtacagataaagtggggttcgcattcgctccaataattttggtgtggtttttattcattggtggaattggcctttacaatttatttaaatatgacattggcgtattacgtgcttttaatccaaaatatatatatgattacttcaaacggaacggcaaggaaggatggatatcacttggtggagtctttttgtgcataacaggatccgaggccatgtttgctgacttgggtcactttaatgtacgatccattcaaattagcttttcttgcatcacatttcctgcaatagtggctgcatatattgggcaagcagcatttctacggaagttccctgagaaagtggccaatactttctatgatagtataccggatcccttatattggccaacatttgttgttgctgttgctgctgccattatagctagccaggcaatgatttcgggagcattctctattatatctcaggccctaagtctaggttgtttcccaagagttagggtagtgcacacttccattaaacatcagggtcaggtgtatattcctgaggtcaactacatgttcatgattgcatgtattgtggtctgtgctgccttcaagaccacagaaaagattagccatgcatatgggattgcagttattggtgatatgatgatcacaacaacactagtttcgctaataatgcttgttttgtggaaaaagagtctgtggcgagtgggtctgttctttttgggattcggtttcgttgagattgtttatttctcttctcaactaaccaagtttacaggaggagggtatcttccaatagtatcagctatgttcttgacggcagtgatgggaatctggcattatgtgcacaaagaaagatacatgtttgaattgaaaaacaaggtttcgagtgcgtatttgaatgaactggccaacaacccagacgtaaggagagtgcccggaataggacttctgtactcagagctagtacaaggcattcctcccatattccaacacttaatagacaacataccatctatccattcaattattgtgtttgtctccatcaaggcaattcctgttagtagagttgcatcagaggagcgctttttgtttcggcaggtggagccgagagattacagagtttttcgttgtgttgtgaggcatggttacaatgacgtgcttgaggatcctgcagagtttgagtcacacttgatacaaaatctcaaggcattcgttcaacatgagaactatatgctcgaggttgatggaactgaacacgcatcagctgagactgagatgatagcagcagtaggtaagggttcttccaacagaataatcccagatcaagctgcagcctcatccgactccattcgatcattgggggccagtgcgaccaagtcatcctctttcatttccccacccatccagggagctgaagacgaaatcaaattcatagacaaagcattggagaagggcgtcgtctatatgctagcagaagcagaggtagttgctcacccatcttcctccatcttgaataagattgttgtcaactatgtttatagcttcttcagaaagaactttagacaaggccagaattccatggcaatccaacgcaacagacttctcaaggttggaatgacttatgaaatatgacctcgatttccagtagtttcactgtccatacataaaaataaagaaatatgtactttgcttgaattttgtatcttttccaccaaatcatgcaagttataagttatgttcaagaaaaagccttcgctccaataagccttcaaaactttccaaaatataagcaatcccaatgcccaacatcatcggagtcggagctagacactttcacagaaagtgccaactttgaatcatttatgtgtattgatactttttttattttttaaactaaacaaagctcatttcattgcatta

SEQ ID NO: 54 - DNA, 1127 bp, Oryza sativa
gtacacaaaccacaaacccgcatcgtctcctcctcctccacttgttgttcaattccccccccccctctctctctctctctctctccgtcgcagatctcggcaagggggcaacaaggtaggaggcggcgatgggttcggcgagccgcgcggtgtcgtgcctgtgctgcccgtgcaagtgcctggcgtgcggcctcttcagctgcctctgcagcatcctcatctccctcctcgtcaccctcggcgtcctcgccctcatcttctacctcatcttccgcccccacatgatcgccgccaccgtcgactccgccgccctcacccagttcaccctctccaccaactccgccctcgcctacagcctcaccgtcgacctcaccgtccgcaaccccaacaagcgcgtcggcctctactacgacaacgtcgagtccctcgccctcttcgacggccagcgcttcggctacgcccccctcgactccttctaccagtccaccgaggcatccaccaagctctcccccgccttcaagggccagcagccgctccaaggcgacatcaccgccgccaacttcaggtcgcagcagaccgccggcaagttcgacatcgaggtcaagctcaacgccaagctcagggtcaaggtctgggccttcaaggttcccggacccaaggccaagatcagctgccccatcaccgtcccagcgtccgcccccaacgcccccgcattccagcgcaccgactgcaaagtctggttctgatttcgatggttggttccgcttcgcatttggggattactattagccagcactgcttccagtatggacggatggattcttttgtttctttcgatttgttgatgagggattagctcgccggatgttgctgtacatcgctgtggtttaggtggttacatatcttctagcccttgtagctagcgcttgtcatgcacatattatcgatccatgtcttgttcttcttagttttttcccctttcttttgggtacggcttacttactgctgttcagatcatatatgactgtatgttggttgatacattcagagattttattcaggatcacctattacttctatgagtgacatctattatgattccttggttgattctgagttgtgccact

SEQ ID NO: 55 - DNA, 1052 bp, Zea mays
gaattccattgtgttgggtagtcgtgctcgtcttcgtccacctcccgacccgactgaatagcaagcaattctccaaattagggtttctttccgcttgctttccagtttgcggcatcagtcggtggcgcctgcgatggagtctctgttcggccaatcgcagcggaggaggagggcgggcggcagcggcttcgaatcgctcaagcgtctgggtcacatctcacccgctgtgcagtcccacctcaaacatgtgtacctcaccctatgctccgcgctggccttctctgcactcggcgcgtacctccacatcctcctcaacgtcggaggcgccctcacgaccgtgggatgcgtggcctccatcgccttcctcatctccctgcccgcttcacgggaccaggagaggaaccgcttggcgctgctcatgtctgccgcgctccttcaaggcgcgtccgttggtccgctcgtcgaccttgttattgacttggattcgaggattctcgtcactgcgttcgtcgggaccgcagttgcttttgcatgcttctctggcgctgccatcatcgccaagcgcagggaatacctgtacctcggcggtctgctttcatctggcctctccattcttctctggctgcagtttgctacttcaatctttggccacaccagcgcgaccttcatgtttgagctctactttggcctcctggttttcctgggatatatggtgtttgacacccaggagatcatcgagagggcgcaccgtggggacatggactacatcaagcacgcgctgactctcttcaccgactttgttgcggttcttgttcgaatccttgtcatcatgatgaagaatgcacaggagaaatcccaagacgagaagaagaggaagaagcggtagctgctgaatgaattggatgacatatgttgttgtggtcactacttcatagtaccgtgtactcctatcctattgtactaataataataatagtaagacgaaagatgactgctgggaatgaatatttggttctgctatttttgtgttgatttgctactgatgaaaaacc

SEQ ID NO: 56 - DNA, 1052 bp, Zea mays
gaattccattgtgttgggtagtcgtgctcgtcttcgtccacctcccgacccgactgartagcaagcaattctccaaattagggtttctttccgcttgctttccagtttgcggcatcagtcggtggcgcctgcgatggagtctctgttcggccaatcgcagcggaggaggagggcgggcggcagcggcttcgaatcgctcaagcgtctgggtcacatctcacccgctgtgcagtcccacctcaaacatgtgtacctcaccctatgctccgcgctggccttctctgcactcggcgcgtacctccacatcctcctcaacgtcggaggcgccctcacgaccgtgggatgcgtggcctccatcgccttcctcatctccctgcccgcttcacgggaccaggagaggaaccgcttggcgctgctcatgtctgccgcgctccttcaaggcgcgtccgttggtccgctcgtcgaccttgttattgacttggattcgaggattctcgtcactgcgttcgtcgggaccgcagttgcttttgcatgcttctctggcgctgccatcatcgccaagcgcagggaatacctgtacctcggcggtctgctttcatctggcctctccattcttctctggctgcagtttgctacttcaatctttggccacaccagcgcgaccttcatgtttgagctctactttggcctcctggttttcctgggatatatggtgtttgacacccaggagatcatcgagagggcgcaccgtggggacatggactacatcaagcacgcgctgactctcttcaccgactttgttgcggttcttgttcgaatccttgtcatcatgatgaagaatgcacaggagaaatcccaagacgagaagaagaggaagaagcggtagctgctgaatgaattggatgacatatgttgttgtggtcactacttcatagtaccgtgtactcctatcctattgtactaataataataatagtaagacgaaagatgactgctgggaatgaatatttggttctgctatttttgtgttgatttgctactgatgaaaaacc

SEQ ID NO: 57 - DNA, 1120 bp, Hordeum vulgare
ctcgtgccgaattcggcacgaccaatcccctcccctcccctctcccgccgccgaatctccctcagctcctccccgccgcctcagtcgccgtcgccgtcgcgaaccagcagcagcagctcgcgggacgagatggggtcggggagccgcgcggcgtcgtgcctgtgctgcccgttcaagtgcctggcgtgcgggctcttcagctgcctctgcagcatcctcgtctcgctgatcgtcaccgccggggtcctcgcgctcatcctctacttcatcttccgcccgcagatgatcgcggccaccgtcgactcggcctccctcacccagttcgcgctcggccccgccaaccccgccctcctccagtacaacctctcggtcgacatgacggtgcgcaaccccaacaagcgggtcggcctctactacgaccgcgtcgaggcgctggccctcttcgacggccagcgcttcgggttcgcgcccctcgaccccttcttccagggccaccaggcgtccacggacctcaagccggcgttcggcggccagcacgtgctcgacggcgacgtcacacagagcaacctccggacgcagctggcggcaggggcggtcgaggtcgaggtcaagctcaacgccaagctccgcgtcaaggtgtgggcgttcaaggtgcccgggcccagggccaggatcagctgcccgctctccatccccgcccccggcggcgccgcccccgccttcaaacccacggactgcaaggtctggttctgattccgccatggattcgattccttggtgctcgtttggggatccgatccggtccggtctcttctctcctctcctctcgcttggattcgattgaccaccgtcccattactatgtatgtagatcttgctagagattttcgcatctactgctgctagtggtactagttggattcgtagctgtattgcacatactactactactatcgattggtcgattactcgttcctttggttctttgttagcggtagtactactcgtaccatatactccagttatattgagattgattctagtatagtagtagtactattttaccagtgttgatatattgatcgatattcagatttcattcagactctacctggctgttg

SEQ ID NO: 58 - DNA, 1204 bp, Hordeum vulgare
caccgccacaaatcacccaaatccaaccaccaatcccctcccctcccctctcccgccgccgaatctccctcagctcctccccgccgcctcagtcgccgtcgccgtcgcgaaccagcagcagcagctcgcgggacgagatggggtcggggagccgcgcggcgtcgtgcctgtgctgcccgttcaagtgcctggcgtgcgggctcttcagctgcctctgcagcatcctcgtctcgctgatcgtcaccgccggggtcctcgcgctcatcctctacttcatcttccgcccgcagatgatcgcggccaccgtcgactcggcctccctcacccagttcgcgctcggccccgccaaccccgccctcctccagtacaacctctcggtcgacatgacggtgcgcaaccccaacaagcgggtcggcctctactacgaccgcgtcgaggcgctggccctcttcgacggccagcgcttcgggttcgcgcccctcgaccccttcttccagggccaccaggcgtccacggacctcaagccggcgttcggcggccagcacgtgctcgacggcgacgtcacacagagcaacctccggacgcagctggcggcaggggcggtcgaggtcgaggtcaagctcaacgccaagctccgcgtcaaggtgtgggcgttcaaggtgcccgggcccagggccaggatcagctgcccgctctccatccccgcccccggcggcgccgcccccgccttcaaacccacggactgcaaggtctggttctgattccgccatggattcgattccttggtgctcgtttggggatccgatccggtccggtctcttctctcctctcctctcgcttggattcgattgaccaccgtcccattactatgtatgtagatcttgctagagattttcgcatctactgctgctagtggtactagttggattcgtagctgtattgcacatactactactactatcgattggtcgattactcgttcctttggttctttgttagcggtagtactactcgtaccatatactccagttatattgagattgattctagtatagtagtagtactattttaccagtgttgatrtawtgatcatattcagatttcattcagactctacctggctgttgcattgtacagtagtccgtatatatcgccgttgatgttcaaaaagcccaaaaaaaagataatatatctatctaactat

SEQ ID NO: 59 - DNA, 1646 bp, Arabidopsis thaliana
atcgtgagaactaagaaacacccaagaaaacaaacaaactttttaaaaaatgtccgtttcaacacatcaccaccacgtggtcctcttccctttcatgtcaaaaggccacatcatccctctcctccaattcggtcgtctcctcctccgtcaccaccgcaaagaaccaaccatcaccgtcaccgttttcaccactcccaagaaccaacctttcatctcagacttcctctcggatacgccggagatcaaagtcatctctctccctttcccggaaaacatcaccggaatccctcccggcgtcgagaacaccgaaaagctcccatccatgtcacttttcgtccccttcacacgcgccacgaagcttctccaacctttcttcgaagaaacactcaagactcttccaaaagtttcgttcatggtctctgatggattcctctggtggacatcggagtctgcagctaagttcaacattccaagatttgtctcctacggcatgaactcttactccgccgctgtctccatctctgttttcaaacacgaactctttaccgaaccggaaagtaaatctgataccgaaccggtcactgtaccagactttccatggatcaaggtcaagaagtgtgatttcgaccatggcactaccgagccggaagaatcaggtgcagccctcgaactatctatggaccaaatcaagtcgaccaccacaagccatgggtttttagtcaatagcttctacgagctcgagtcagcatttgttgattacaacaacaactctggtgataaaccaaagtcgtggtgtgttgggccactgtgtttgacagatcctcctaaacaggggagtgctaaaccggcttggattcattggttggatcagaagcgagaggaagggcgtccggttttgtacgtggcgtttggaacgcaggcagagatatcgaacaagcagcttatggaactagctttcggcttggaagattcaaaggtgaactttctgtgggtcacaagaaaagatgtggaggagattattggagaaggattcaacgatagaataagagagagtgggatgatagtgagagattgggtggaccaatgggagatattgtcacatgaaagtgtcaaaggatttttgagccattgtgggtggaactcagcacaagagagcatatgtgtcggggtcccattgttggcttggccgatgatggccgagcaaccgctcaatgcgaagatggttgtggaggagataaaggtgggagtaagagttgaaacggaagatgggagtgtaaaaggttttgtgacaagagaagaactaagtggaaagattaaagaactgatggaaggagaaacggggaaaaccgcaagaaagaatgtaaaagaatattcgaaaatggcgaaagcggctttggtcgaagggactggttcgtcatggaagaatttagatatgattcttaaggagttatgtaagagtagagattcaaacggtgctagtgagtagagtgattaagaattgaataactgaaccagtctatacgtttactaattaaaacaagtattttcaatatacgtcttgtgtaagtcttggtttagttgaaaagatgttatcgattacaataactgactctctcatttgataatactgactatgattaatatta

SEQ ID NO: 60 - DNA, 1646 bp, Arabidopsis thaliana; identical to SEQ ID NO: 59

SEQ ID NO: 61 - DNA, 1601 bp, Arabidopsis thaliana
aatagagatacaaagaaacaagaaaacgaaaagaaaatatacagaaatgggtggtttgaagtttcatgtacttatgtatccatggttcgcaacaggccatatgaccccgttcctttttcttgccaacaaattggctgagaaaggtcatacggtcactttcttgcttcccaagaaatctctgaaacagttggaacatttcaatctgtttccacacaacattgtctttcgctctgtcaccgtccctcatgtggatggtctccccgttggcacagagacagcctctgagatccctgtgacatcaactgatctcttgatgtctgctatggatctcacacgtgatcaagttgaagctgtggtccgagccgttgaaccggacctgatcttctttgactttgctcattggattccagaagtagctagggacttcggccttaagactgtaaagtacgtcgtggtgtctgcatcgactatagctagtatgcttgtcccaggtggtgagttaggtgttcctccaccgggatatccatcatcaaaggtgctgcttcgtaaacaagatgcttacactatgaagaaactggagcctacaaatacaatcgatgtcggaccaaacctcttggaacgagtcactacaagtcttatgaactctgatgtcattgcgataaggacagccagagaaatcgaaggaaacttttgcgactatatagaaaaacattgcaggaaaaaggttctcttgacaggtccggtgttccctgagccagacaagactagagagctagaggaacgatgggttaagtggctaagtgggtatgaaccagactcagtggtgttttgtgcactgggctcacaagtcattttagagaaagatcaattccaagaactctgcttaggaatggagctaacaggttcaccgtttcttgtagcggttaagccccctagaggctcatcaacgattcaagaagcacttcctgaaggattcgaagagcgggttaaaggaagaggccttgtttggggaggatgggttcaacaaccattgatattgtctcatccatcagtcgggtgctttgtgagccattgtgggtttggatcaatgtgggagtctttgctgagtgattgtcagatagtcttagtaccacagttgggtgatcaagtcctgaacacaagattgctgagtgacgaactcaaggtttcggttgaagtggcaagagaggaaacaggatggttctcgaaagagagcttgtgcgatgctgtcaatagtgtgatgaaaagggacagcgagctcgggaacctggtgaggaagaatcacaccaagtggagggagacagtagctagtcctggactaatgactggttatgtcgatgctttcgtagagtcattgcaggatcttgtctctgggaccacccatgactgaaagataggaacactatgacgtttctaagtagaagggggtgattaataaggttgatataaaccaaactatcttgaagtgcttatgtttccaagtgtgttttttcttgtttgtatggttcatttattgtttgatgtttctaagttgcagtgagtgatcatttaatgttttcttttttaataaacaaactatgtag

SEQ ID NO: 62 - DNA, 1601 bp, Arabidopsis thaliana; identical to SEQ ID NO: 61

SEQ ID NO: 63 - DNA, 1447 bp, Solanum lycopersicum
gctcaattcacgcccaattttctctctcttcccttaccccaaaggttccatctctttgccctctttccaaatctcccaaatcccccaaaattctagggttttcatttccctgttgaaatttggatcggtgctttgttttagtttttgtgtagaggttccgattcctggattttgtgggagaattttgggggattccaattgtatattaagagaaagagatgagttttcaagatcttgaagcgggtcgaccattggggccccgtagagggtatatgaatggtaagcaagacccaactcaagctgtggcttctggaattttccagattaacactgctgtgtcaacgtttcaaaggctggtcaatacacttggaacacccaaagatacacccgagctgcgtgagaagttgcacaagacgagggtacatattgggcagttagtgaaagatacatctgcaaaacttaagcaagccagcgaaacagatcatcgtgttgaagtcagtgctagcaagaaaataacagatgctaaacttgctaaagattttcaagcagtcttgaaggagtttcaaaaggctcaaaggcttgcagctgagagagagacagcatatacaccttttgttccccaagcagttcttccttcaagttatacagccagtgagatagatgtttcttcgggaaagagtccagaacagcgagctctccttgtggaatcaagaagacaagaggttttacttttggacaacgagatagcctttaatgaagcaatcatcgaagaaagagagcagggaatacaagaaatacaacaacaaattggtgaagtgaatgaaattttcaaggaccttgctgtgcttgttcatgagcaaggagctatgattgatgatattggttctaacgttgagaatgctcatgctgcgactgcacaggggagatcgcaacttgctaaagctgcaaagacccaaagatcaaattcatctctgacttgcttactcctggtgattttcggaatcgtgctcctcattgtgatcgtagtacttgcagcctgagctgaagattactgggatatagagaagggtcccgaactctgttcagacacagaagtgagtgctttgattcgaaaaaaagtgactgttatgattcgagtcatttcaataggcatcctggagtgtggctcggttgtcccaacccttgttcttcttgtcatggttgataagtcgtgtagttagggaggtgggataagaaaggttcctgttcaacttgtaaacctggtgctgtgtttgcaagatgtattgctgacatgtattggtgggtctgtcaataacagtttatttttgtttgaggagcaatctcttatatttgccctttggatactcttgaaccagatgacattcaattctttattgatgcttgtgtgtgtgtgaagttatcactaatgggatatgttgatttgttt

SEQ ID NO: 64 - DNA, 1483 bp, Solanum lycopersicum
gaattcctccctcaattcacgcccaattttctctctcttcccttaccccaaaggttccatctctttgccctctttccaaatctcccaaatcccccaaaattctagggttttcatttccctgttgaaatttggatcggtgctttgttttagtttttgtgtagaggttccgattcctggattttgtgggagaattttgggggattccaattgtatattaagagaaagagatgagttttcaagatcttgaagcgggtcgaccattggggccccgtagagggtatatgaatggtaagcaagacccaactcaagctgtggcttctggaattttccagattaacactgctgtgtcaacgtttcaaaggctggtcaatacacttggaacacccaaagatacacccgagctgcgtgagaagttgcacaagacgagggtacatattgggcagttagtgaaagatacatctgcaaaacttaagcaagccagcgaaacagatcatcgtgttgaagtcagtgctagcaagaaaataacagatgctaaacttgctaaagattttcaagcagtcttgaaggagtttcaaaaggctcaaaggcttgcagctgagagagagacagcatatacaccttttgttccccaagcagttcttccttcaagttatacagccagtgagatagatgtttcttcgggaaagagtccagaacagcgagctctccttgtggaatcaagaagacaagaggttttacttttggacaacgagatagcctttaatgaagcaatcatcgaagaaagagagcagggaatacaagaaatacaacaacaaattggtgaagtgaatgaaattttcaaggaccttgctgtgcttgttcatgagcaaggagctatgattgatgatattggttctaacgttgagaatgctcatgctgcgactgcacaggggagatcgcaacttgctaaagctgcaaagacccaaagatcaaattcatctctgacttgcttactcctggtgattttcggaatcgtgctcctcattgtgatcgtagtacttgcagcctgagctgaagattactgggatatagagaagggtcccgaactctgttcagacacagaagtgagtgctttgattcgaaaaaaagtgactgttatgattcgagtcatttcaataggcatcctggagtgtggctcggttgtcccaacccttgttcttcttgtcatggttgataagtcgtgtagttagggaggtgggataagaaaggttcctgttcaacttgtaaacctggtgctgtgtttgcaagatgtattgctgacatgtattggtgggtctgtcaataacagtttatttttgtttgaggagcaatctcttatatttgccctttggatactcttgaaccagatgacattcaattctttattgatgcttgtgtgtgtgtgaagttatcactaatgggatatgttgatttgtttatcttggctgggggattatcttgcatg

SEQ ID NO: 65 - DNA, 2610 bp, Triticum aestivum
ccacgcgtccgcttcacagctctctctctctctacccccaaaaccccattgcattcccggctttcaaatccgccaccttttcccctccctatttctctctccaccctctactgctcccgagaagagagaagagagagagaggaggaacccaaggcgaggccggcctcaaaagaaccactcaccttcccgcagccactctctctctcatcacgcacatcacacacgcccgctggtagctgcagccgccgctcgctctcaccggtagctagccggccgttggagcccccgctgcggctgcctgcttaaaggaggaggagggcgggagcaatgtcggagcagccattgccgcagccgcggagcagcatgagggaggcgctgcagaaggaggacaaggagaaggcgtcggcggcggcgccccctgccaaggagaaggcggccgtgcccccgccccccgtcgccgcgccccccatggccaagaacggcggtggagggggcaagggcggcaacggggcccagccgccggcggcggaggagacgacgcgggagatccaggtggtgcgcgaggcgtaccggcagccggcggccccggcgtacgtgatgccggaggagccgcccgccatggtggagctggtggggtggtacctctacggcttctgctccttcttcatcacccacctgctgctgccggtgctgttcccggccatcgtcacccaggtcgccttcccctcctccgacttcacccccgaggccaagtacaccgtcaagggcgcctcctgctccgtccacgagatgtccatgtaccagaggctgaccaggtacaccattgmcatctctagctcccacatgtcgcccctgggctggagcgccctctcgtgggcgatcggcatcctcctcgtggcgccgctcctcacccaggtygcgcaccacctcgacmggggccagtaccagtcgctcatcctcatcgccgcgacgtcgttcggctccttcttctgcctgctcaccggcttcttcaagacggtctgggtgttcctgttctacatcctcttcatcgccgcgtccatcatcatcgccgaggcggtgcacacccgcaacctcgggctgatgatccgyggcctygccgcycaygactcgggcaagcaccttgtcctgcgccgccgcgctgctgccagccagctcagcctctactgcaccgccatcggcggcatcggsgcggcsctcatggctgcgttcatgtaccacatgctgaggcgcactgaccagctcaccggcctctgggtcgtctccatcttcagtggcctcatctggttcatcggcatctgccatggcctcttcacgaacaggcccagcagctcgtcacccaccaccgcattcgagccaaacttcatcagcaagctcaagtacagcatgaccattggccrctacccacaggccattggaagcttggtggcagtgttcctttcatcttttgccacaatgtgcatcttcaccagtggcacgctctatgccattggcggcgtctgcatcaagccggtcctggtgctcgcgctgtggatcctctacttcctgttcccgctcatctcgctgccgctgctccacccaatccagatcatcatccgcgccgacgccgtccgcatgcagctgctcgggttcatcatcgccctcttcgtctccggcgccgggttctacttcaagagccacaggtggagggccgcccacatcatcatcatcgccctcgtccagagcaccgccaacggcatcctctactccttcggccgcatcctgctgctcgacgcctcgccgccgggcaaggagggcgcgttcgccatctggtacgcgtacgtccgctgcatgggcgccatgatcggcttcgccgttgcatctgctggccctgggcgcgcgggagggtcctttgctgccgccttcctgggcagcttcctcggcatcatcgtgctcatcttcggcaacgtcagcaacatcggcgcgctcaaggccgccgggcacctcaagggcatggaggacgacaagaggatcggcgagaagggcgagggcatgagcgccgtcgccgactccggcgagtctagggggagggtatgattgattacatggggctggaaagaaagattgcttgccgccattgttgttgtggtgggttgtgcttgtgagaagggtatgatttgttcttcttttttttcttgttttttctttcttgttcatgtctcagtgacactgttaatccggtgctctgcccctttgatgcatgatgattatgatgatgttgacatagtggtagagggagtgctagcagctctgttaatgtgttaaattcttttttgcttggaagacagacaattacctcggccgcgaccacgctatcccgcggscactggcggccggagacattccaccctcgggcccaatcggccccaagggaggccctataacaatccactggcggcggttaacaaaacagtagcctgggaaacccctggcgtataacacactaaacggcgctggcccccacaccccctttcgcgaggtcgcggtgtgctcgagagaggcgggcccggttggggttccccgaagctgggcaactggcgtccggaagtgcgc

SEQ ID NO: 66 - DNA, 2610 bp, Triticum aestivum
ccacgcgtccgcttcacagctctctctctctctacccccaaaaccccattgcattcccggctttcaaatccgccaccttttcccctccctatttctctctccaccctctactgctcccgagaagagagaagagagagagaggaggaacccaatccgaggccggcctcaaaagaaccactcaccttcccgcagccactctctctctcatcacgcacatcacacacgcccgctggtagctgcagccgccgctcgctctcaccggtagctagccggccgttggagcccccgctgcggctgcctgcttaaaggaggaggagggcgggagcaatgtcggagcagccattgccgcagccgcggagcagcatgagggaggcgctgcagaaggaggacaaggagaaggcgtcggcggcggcgccccctgccaaggagaaggcggccgtgcccccgccccccgtcgccgcgccccccatggccaagaacggcggtggagggggcaagggcggcaacggggcccagccgccggcggcggaggagacgacgcgggagatccaggtggtgcgcgaggcgtaccggcagccggcggccccggcgtacgtgatgccggaggagccgcccgccatggtggagctggtggggtggtacctctacggcttctgctccttcttcatcacccacctgctgctgccggtgctgttcccggccatcgtcacccaggtcgccttcccctcctccgacttcacccccgaggccaagtacaccgtcaagggcgcctcctgctccgtccacgagatgtccatgtaccagaggctgaccaggtacaccattgacatctctagctcccacatgtcgcccctgggctggagcgccctctcgtgggcgatcggcatcctcctcgtggcgccgctcctcacccaggttgcgcaccacctcgacaggggccagtaccagtcgctcatcctcatcgccgcgacgtcgttcggctccttcttctgcctgctcaccggcttcttcaagacggtctgggtgttcctgttctacatcctcttcatcgccgcgtccatcatcatcgccgaggcggtgcacacccgcaacctcgggctgatgatccgtggcctcgccgctcacgactcgggcaagcaccttgtcctgcgccgccgcgctgctgccagccagctcagcctctactgcaccgccatcggcggcatcggcgcggccctcatggctgcgttcatgtaccacatgctgaggcgcactgaccagctcaccggcctctgggtcgtctccatcttcagtggcctcatctggttcatcggcatctgccatggcctcttcacgaacaggcccagcagctcatcacccaccaccgcattcgagccaaacttcatcagcaagctcaagtacagcatgaccattggccactacccacaggccattggaagcttggtggcagtgttcctttcatcttttgccacaatgtgcatcttcaccagtggcacgctctatgccattggcggcgtctgcatcaagccggtcctggtgctcgcgctgtggatcctctacttcctgttcccgctcatctcgctgccgctgctccacccaatccagatcatcatccgcgccgacgccgtccgcatgcagctgctcgggttcatcatcgccctcttcgtctccggcgccgggttctacttcaagagccacaggtggagggccgcccacatcatcatcatcgccctcgtccagagcaccgccaacggcatcctctactccttcggccgcatcctgctgctcgacgcctcgccgccgggcaaggagggcgcgttcgccatctggtacgcgtacgtccgctgcatgggcgccatgatcggcttcgccgttgcatctgctggccctgggcgcgcgggagggtcctttgctgccgccttcctgggcagcttcctcggcatcatcgtgctcatcttcggcaacgtcagcaacatcggcgcgctcaaggccgccgggcacctcaagggcatggaggacgacaagaggatcggcgagaagggcgagggcatgagcgccgtcgccgactccggcgagtctagggggagggtatgattgattacatggggctggaaagaaagattgcttgccgccattgttgttgtggtgggttgtgcttgtgagaagggtatgatttgttcttcttttttttcttgttttttctttcttgttcatgtctcagtgacactgttaatccggtgctctgcccctttgatgcatgatgattatgatgatgttgacatagtggtagagggagtgctagcagctctgttaatgtgttaattcttttttgcttggaagacagacaattacttcggccgcgaacagcctaatcccgcggccactggcggccggagacattccaccctcgggcccaatcggccccaagggaggccctataacaatccactggcggcggttaacaaaacagtagcctgggaaacccctggcgtataacacactaaacggcgctggcccccacaccccctttcgcgaggtcgcggtgtgctcgagagaggcgggcccggttggggttccccgaagctgggcaactggcgtccggaagtgcgc

SEQ ID NO: 67 - DNA, 1698 bp, Hordeum vulgare
tcatattggtcatgcacccacagagcattatatcccgacattctcckgcacgagggcagccaccacctactcttcgtctccggcgatgtgtagcagccgccggcggggcgaccgccagctccagctcctgcaccgcctcctcgcgctctcctcgctgctcctgctcgcctccggggaggtcatcttcgaggagcggttcgaagatggttgggagacacgttgggtgaaatccgattggaaaaggagcgaagggaaagccggtacattcaagcacacggcagggaaatattctggggatcctgatgacaaaggcattcaaacaacgatagatgctaggcattttgccatctcagccaagataccggagttcagtaacaagggccgaacattggtggtccagtactccataaagtttgagcaggaaattgaatgtggcggcggctatattaagctaatgtctggttatgtcaatcagaagaaatatagtggagacactccatacagcttgatgtttgggccagatatatgcgggactcaaacaaagaagctgcatcttatactctcttaccaggggcagaactatcctatcaaaaaagatctacaatgcgaaaccgacaggctcacgcatgtttacacattcattcttaggcccgatgcatcttatagtttacttgttgataaccgtgaaagagaatctgggagcatgtacactgattgggacatcttgcctcctcgtaaaatcaaggatgttggtgccaaaaagcctaaggattgggatgacagagagtatattgaggatcccgatgcggttaaacctgagggctatgattctattccaagagagattcctgacccaaaggataagaagcccgacacgtgggacgatgatgatgatggcatatggaaacctaggaggataccgaatccagcatacaaaggacaatggaagcgcaagaaaattaagaaccctaactacaagggtaaatggaagatcccatggattgataatccagagtttgaggatgatccagatttatatgtactgaaacctctgaagtatattggaattgaagtttggcaggtaaaagccggttctgtttttgacaacatcctcatttgcgatgacccggaatatgcaaaacaggttgccgatgaaacgtggggtgcaaataaggaggctgaaaaggaggcttttgaagaagctgaaaaggagaggaaagctagagaagataaggaagctcaacaagcaagggaggaaggagagcgacggaggagagagaggggtgatcgacaccgtggcagggaccactacaaggacagatacaaaagacgcaacagggatcactgggatgactaccatgatgagctttgaggccccaaaaatcttccattattcgaaggagaagctgggatttgacatgaacattgcgttatagttgctgccaataattgaagtgttccttgtctcgtgtgagggaaactgattgaattgaccacgaagatcattcctatgtgacagcagggcagacaattccacctatcctcaaaagtcaaaaacttggccttggccctgaaatctgatgttgtgagtgtaatgtacatggtcagcgatgtgcttccttttgtaaacagctgttgctaatacaaataaagagattttcaagcataattcaaatgactattgttgagcggccgcca

SEQ ID NO: 68 - DNA, 1700 bp, Hordeum vulgare
tcatattggtcatgcacccacagagcattatatcccgacattctcctccaccgtatcatagcgtcctctctactcttcgtctccggcgatgtgtagcagccgccggcggggcgaccgccagctccagctcctgcaccgcctcctcgcgctctcctcgctgctcctgctcgcctccggggaggtcatcttcgaggagcggttcgaagatggttgggagacacgttgggtgaaatccgattggaaaaggagcgaagggaaagccggtacattcaagcacacggcagggaaatattctggggatcctgatgacaaaggcattcaaacaacgatagatgctaggcattttgccatctcagccaagataccggagttcagtaacaagggccgaacattggtggtccagtactccataaagtttgagcaggaaattgaatgtggcggcggctatattaagctaatgtctggttatgtcaatcagaagaaatatagtggagacactccatacagcttgatgtttgggccagatatatgcgggactcaaacaaagaagctgcatcttatactctcttaccaggggcagaactatcctatcaaaaaagatctacaatgcgaaaccgacaggctcacgcatgtttacacattcattcttaggcccgatgcatcttatagtttacttgttgataaccgtgaaagagaatctgggagcatgtacactgattgggacatcttgcctcctcgtaaaatcaaggatgttggtgccaaaaagcctaaggattgggatgacagagagtatattgaggatcccgatgcggttaaacctgagggctatgattctattccaagagagattcctgacccaaaggataagaagcccgacacgtgggacgatgatgatgatggcatatggaaacctaggaggataccgaatccagcatacaaaggacaatggaagcgcaagaaaattaagaaccctaactacaagggtaaatggaagatcccatggattgataatccagagtttgaggatgatccagatttatatgtactgaaacctctgaagtatattggaattgaagtttggcaggtaaaagccggttctgtttttgacaacatcctcatttgcgatgacccggaatatgcaaaacaggttgccgatgaaacgtggggtgcaaataaggaggctgaaaaggaggcttttgaagaagctgaaaaggagaggaaagctagagaagataaggaagctcaacaagcaagggaggaaggagagcgacggaggagagagaggggtgatcgacaccgtggcagggaccactacaaggacagatacaaaagacgcaacagggatcactgggatgactaccatgatgagctttgaggccccaaaaatcttccattattcgaaggagaagctgggatttgacatgaacattgcgttatagttgctgccaataattgaagtgttccttgtctcgtgtgagggaaactgattgaattgaccacgaagatcattcctatgtgacagcagggcagacaattccacctatcctcaaaagtcaaaaacttggccttggccctgaaatctgatgttgtgagtgtaatgtacatggtcagcgatgtgcttccttttgtaaacagctgttgctaatacaaataaagagattttcaagcatattcaaatgactattgttgagcggccgcca

SEQ ID NO: 69 - DNA, 3936 bp, Oryza sativa
gggaaagcgtaacagaacaaactaacttcttctcgagagaggaaaaaaaaaaaagaaaaaccaagaagaagtcgaggagaagagaggaagagtaaagcagcgcgaggaaggaaggcgagtctgctttgcgggattcgcccgtagtagagtttgattccgccgggttggtttggtggtttgatcgggggaggaggaggaggaggatggtggtgcgggagccggtggcgatggagataccggcggtggagtcgtcggcggcggggaggatgccgccgaggatcaggcggcggttgctggaggggagccgcgtcggaggcggggcgccgacgagcgcggaggagatcgaggcgaagctgaaggaggcggagctccggaggcagcaattccatgaatgggtgtcctgcaaagcgaggaagaagccgcggagcccatcatggtcatcacaagaggaagatcaaggtcagcgcctcgaagcgaagcttcaggccgccgagcagaaaaggttgagcctcttggcaaaggcacagaacaggctagccaagttggatgaactccgacaagcggcgaagaacatcgtggaaatgcggatcgagaaagaaagggaagaactcgggactcgagtcgagtctcgtgttcgtcaagcagaggcaaatcgcatgcgtcttttgcatgcacatatgcagaagcgggcggcaatgaaggagagaacggcgcggtcccttgtgcggaaacagacatctgagaggaaatacacggagcgagtcaagtctttgatcttacaaaagcgcaatgctgctgaaaagaagcgactggcattgctggaagctgagaagaggaaagcccaggctaggattttgcacatccaacgagctgccaagactgtatgcagcaagagagaatcagagaggagacagttgcaagaacagctagaaagcaagcttcagaaggcaaaaaggcagagagctgagtacttgaagcagcgggtaagtccccgtagttctgcccatgctgattacatcaagcatgcagaatttctttcaacaaagctggcaagatgctggaaaagatttttgaaatctaacaagacaacatatgcactggttcaagcttatgacgccttgggaattaatgagatgtctgtcaaatctatgccatttgaaaatttagctatgttgatggaatctccaacgactctccagaccaccaaggcagtgcttgaccggttcgagaaacgtttgcttctttctcagccaactggttcatcatcagccgagaacattgatcaccttctgaaacgccttggatctccaaagaggaaggcacctgctagcagatctagggtagctgcgaaaaagccagcgaagggttccgagacaagcaagctttctagatactcactgcgggtagtcctctgctcttatatgatactggctcatccaggtgctgtattaagtggacaaggggagaaggagaatctacttatggagtcagcagaaaactttgttaaggagtttgagctattggttaagacagtacttgatagaccaggaggtgcctcgatgcaatcgactgatgctgccagtcagaaaaagttcaggactcagttggctgcttttgataaagcatggtgcgcttacctttaccactttgttgtgtggaaactgaaggatgccaaatcattggaacaagatcttgtcagggctgcatgcaagcttgagctgtcaatgatgcaaacatgcaagttaagttcagatgggcagtcacatgacctttctcatgatatgaaggcaattcagaaacaggttactgatgaccagaagctgttaagagagaagattcagcacctgagtggcgatgcaggcatcgagcggatgaactctgctctttcggatacaaggtcaaagttctttgaggcgaaggaaaacggaaatccattagcaacatctgttgcaaatgtatctactcctttgagcattaattcatctggacaggttccaaaccctacttccaagcctactgtggaaggatcaagtttcactgcccaatctttgcctggagctgcttcatcgtcaagcagtacatctccaatgaaaccgccgacggacaatgagcaaatggtcaatgagatgcttcatgaggacgatgtttcttttgctcgcaactctgataacgtcagttccgcggagaaggactttcaggccaaagtgaaagcaacgatggagaaagccttttgggatcttgttactgattcgatgagaggggacaaaccagattatagccaattaattaacctcgtaaaggaagtcaggaattcgttacatgagttggcctcaaatgagttgaaggaggaaattcttgagaacattgacctcgaaattttgtctcaggtgcttcagtcaggctcccaggacacgcgatatctggggcagattttgcagtactccctggatatggtcaggaaactatctgcccctgcaaaggaagatgacatgaagaggagtcatgagaaattgttaaacgagttggctgcaagttccgaagttaatgacaatggtatcagctcctttgtcattgctgtcatcaagggcctgcgtttcactctcgaagaaataaagcaactgcaaactgaagttagcaaggctcgcatccagctcatgcaaccaattattaaaggctctgccggagtggaatacctgcagaaggctttcacggatcgctatggacctcctgctaatgcatcagtgtctctccctataactaagcagtgggtttcggcaacgaagagcatcgtggaacaagagtggagctcacatttggagtctctccaagctttgccagcagatcatgctcagcacgttgttccggtacttcgagctggtcacggtgctccagcgccgcaggcttcttcgtctgcagctagcagttctggtctcccagaatgcaagggtgagaagatcgacaagctgacaagggttggcttgttgcaacttatcagcaatgtggagggcctgaacatgcagtcaacccctgagaccttccaaattaatctgctgaggttgagggctgtgcaagatcagtttcagaaggtgatagtgatcgcgacgagcatgcttgtcctgcatcaagttctgatgttgaagatcgctcctccggagctacagaataccatctcagagctctacgacgctctcgtgaagctcctcgacaacaacgctgacgcatcaacgaaggagatcgtggaggcgatgacgcgctctctggcctcggtcggctctctgccggaggaacagattcaggacacgacagagctagcaaccaagatgcttctcaagagcctccaggccggcgacatcgtcttcggtaaggtgtcccgggcggtctactttgccttccgcggcgtcgtcctcggtggcggcgccaagggcaagaagctagccgaagcgccgctgcgacgcctcggcgcggcgaagctcgccgacagggttgtcaaggccggggaggtgctgataaagatggcagtcatatcagagaaggtccatggacaatggtacaaggcgcttgccttgtgaagagcagaatagggtttgtgttgttttgtgaatatacattacggattacggactgtaaattcttgtcctaccggggtgaggtaggaaatattgggcattgtacataaatttatataggtgttaattggtaggctgatttcagtgtcaaaaattaattctgggtgcagggctaatatggatgaccctcaccccagaatttagccagtggttagatgtgctgaattgcacctgggtgtaagttaaatctgatgtaatctatttgctcttggaactgaaataatgtgaatattttaatttaaatattgtgatgtaaatatttcgatcggttgtgcagtggggtgattgaaatttggttggcattcaccag

SEQ ID NO: 70 - DNA, 3884 bp, Oryza sativa
gggaaagcgtaacagaacaaactaacttcttctcgagagaggaaaaaaaaaaaagaaaaaccaagaagaagtcgaggagaagagaggaagagtaaagcagcgcgaggaaggaaggcgagtctgctttgcgggattcgcccgtagtagagtttgattccgccgggttggtttggtggtttgatcgggggaggaggaggaggaggatggtggtgcgggagccggtggcgatggagataccggcggtggagtcgtcggcggcggggaggatgccgccgaggatcaggcggcggttgctggaggggagccgcgtcggaggcggggcgccgacgagcgcggaggagatcgaggcgaagctgaaggaggcggagctccggaggcagcaattccatgaatgggtgtcctgcaaagcgaggaagaagccgcggagcccatcatggtcatcacaagaggaagatcaaggtcagcgcctcgaagcgaagcttcaggccgccgagcagaaaaggttgagcctcttggcaaaggcacagaacaggctagccaagttggatgaactccgacaagcggcgaagaacatcgtggaaatgcggatcgagaaagaaagggaagaactcgggactcgagtcgagtctcgtgttcgtcaagcagaggcaaatcgcatgcgtcttttgcatgcacatatgcagaagcgggcggcaatgaaggagagaacggcgcggtcccttgtgcggaaacagacatctgagaggaaatacacggagcgagtcaagtctttgatcttacaaaagcgcaatgctgctgaaaagaagcgactggcattgctggaagctgagaagaggaaagcccaggctaggattttgcacatccaacgagctgccaagactgtatgcagcaagagagaatcagagaggagacagttgcaagaacagctagaaagcaagcttcagaaggcaaaaaggcagagagctgagtacttgaagcagcgggtaagtccccgtagttctgcccatgctgattacatcaagcatgcagaatttctttcaacaaagctggcaagatgctggaaaagatttttgaaatctaacaagacaacatatgcactggttcaagcttatgacgccttgggaattaatgagatgtctgtcaaatctatgccatttgaaaatttagctatgttgatggaatctccaacgactctccagaccaccaaggcagtgcttgaccggttcgagaaacgtttgcttctttctcagccaactggttcatcatcagccgagaacattgatcaccttctgaaacgccttggatctccaaagaggaaggcacctgctagcagatctagggtagctgcgaaaaagccagcgaagggttccgagacaagcaagctttctagatactcactgcgggtagtcctctgctcttatatgatactggctcatccaggtgctgtattaagtggacaaggggagaaggagaatctacttatggagtcagcagaaaactttgttaaggagtttgagctattggttaagacagtacttgatagaccaggaggtgcctcgatgcaatcgactgatgctgccagtcagaaaaagttcaggactcagttggctgcttttgataaagcatggtgcgcttacctttaccactttgttgtgtggaaactgaaggatgccaaatcattggaacaagatcttgtcagggctgcatgcaagcttgagctgtcaatgatgcaaacatgcaagttaagttcagatgggcagtcacatgacctttctcatgatatgaaggcaattcagaaacaggttactgatgaccagaagctgttaagagagaagattcagcacctgagtggcgatgcaggcatcgagcggatgaactctgctctttcggatacaaggtcaaagttctttgaggcgaaggaaaacggaaatccattagcaacatctgttgcaaatgtatctactcctttgagcattaattcatctggacaggttccaaaccctacttccaagcctactgtggaaggatcaagtttcactgcccaatctttgcctggagctgcttcatcgtcaagcagtacatctccaatgaaaccgccgacggacaatgagcaaatggtcaatgagatgcttcatgaggacgatgtttcttttgctcgcaactctgataacgtcagttccgcggagaaggactttcaggccaaagtgaaagcaacgatggagaaagccttttgggatcttgttactgattcgatgagaggggacaaaccagattatagccaattaattaacctcgtaaaggaagtcaggaattcgttacatgagttggcctcaaatgagttgaaggaggaaattcttgagaacattgacctcgaaattttgtctcaggtgcttcagtcaggctcccaggacacgcgatatctggggcagattttgcagtactccctggatatggtcaggaaactatctgcccctgcaaaggaagatgacatgaagaggagtcatgagaaattgttaaacgagttggctgcaagttccgaagttaatgacaatggtatcagctcctttgtcattgctgtcatcaagggcctgcgtttcactctcgaagaaataaagcaactgcaaactgaagttagcaaggctcgcatccagctcatgcaaccaattattaaaggctctgccggagtggaatacctgcagaaggctttcacggatcgctatggacctcctgctaatgcatcagtgtctctccctataactaagcagtgggtttcggcaacgaagagcatcgtggaacaagagtggagctcacatttggagtctctccaagctttgccagcagatcatgctcagcacgttgttccggtacttcgagctggtcacggtgctccagcgccgcaggcttcttcgtctgcagctagcagttctggtctcccagaatgcaagggtgagaagatcgacaagctgacaagggttggcttgttgcaacttatcagcaatgtggagggcctgaacatgcagtcaacccctgagaccttccaaattaatctgctgaggttgagggctgtgcaagatcagtttcagaaggtgatagtgatcgcgacgagcatgcttgtcctgcatcaagttctgatgttgaagatcgctcctccggagctacagaataccatctcagagctctacgacgctctcgtgaagctcctcgacaacaacgctgacgcatcaacgaaggagatcgtggaggcgatgacgcgctctctggcctcggtcggctctctgccggaggaacagattcaggacacgacagagctagcaaccaagatgcttctcaagagcctccaggccggcgacatcgtcttcggtaaggtgtcccgggcggtctactttgccttccgcggcgtcgtcctcggtggcggcgccaagggcaagaagctagccgaagcgccgctgcgacgcctcggcgcggcgaagctcgccgacagggttgtcaaggccggggaggtgctgataaagatggcagtcatatcagagaaggtccatggacaatggtacaaggcgcttgccttgtgaagagcagaatagggtttgtgttgttttgtgaatatacattacggattacggactgtaaattcttgtcctaccggggtgaggtaggaaatattgggcattgtacataaatttatataggtgttaattggtaggctgatttcagtgtcaaaaattaattctgggtgcagggctaatatggatgaccctcaccccagaatttagccagtggttagatgtgctgaattgcacctgggtgtaagttaaatctgatgtaatctatttgctcttggaactgaaataatgtgaatattttaatttaaatattgtgatgtaaat

SEQ ID NO: 71 - DNA, 2197 bp, Solanum lycopersicum
ctcgtgcccaaagatgttgagtgagccaggagctgaaggactcgattctcgtggagccttccttgttcttattccttctgttatatacgtgtggatagggaagcattgtacctcggtaatgtcagataatgccagggctgcagcctttcaggtaatccgctatgaaaaggcccaaggtcctgtcttaattatcaatgaaggcaaagagccttctgatttttggagtgcgattagtcaggaaagcttcttttctggtggttgtggcaaagaaaagaacaaggtggaagccagtttattagctgaaaatgacttaattactgataatatcagccagtgtattggtcaaaagaatgaatatgatcttgattttgaaattttctgcaaagcactcgccggtggtgttgttccaccttttccattgtcaggtactgaatctgagacatgtcttcccgcaagacagaatggatggagtagattgagacggaagttttccagtggaataatgaaagaatttatcacagcttccaagttatacagtcatactggcataacaagtcctgtacttgataagatagacaccattaaagaactctctcctgctttgccttcatcaccttcaagtcctcagtgtggatcaccagattctttctcttcttatgcaaccagtagtccaagttggacaaaggatccttgtagagatgtggaaaaccctggtcttgatacagagcctgtgtcgccatctccttcattcagctcacttgattctctctcttgttttcttgktagtaaaccaaagtytaatgccacatccccgtcactctcacctksracctcagattactccagtkctttcaccttttctccctcctcttccaattggtctgacttggcatacctatctgcacagccttcacccacgagatttgaacatgaggatcctaattttgtgaagaatgatttcttcaaagtaagttcatctttactttgtaaaggatcaccctttccagcagcagaggaagcatttccaaccagtcgtgctcttagacgggcaaacagttgtttacagtacagagaaacttccccttcactagcagagcgtagaggcagtcatcctcctcctatgatgatgttacgttccaatgatgattccgctcaaatttcagtgaaattggtgagaacatcatcattttctcttcctaattttgaagatgatacaatgaagtgtgttgagtgtgacagccttaatgacggagattttgttgatactagtaaagaggcgctaatgttagatgctgagaattcgattactgacaatcaactccaaaatggagttcaacctgtagatgatgtatctggcagtttcaatgaccgtccaattggcattcccatccgagttgcagaaacaactgatttaggtctttaccagtggccttctatgcataaattaggcttgtcttctgtggttttcgattcaaggtccgtttatatcatagtcattcctgacttgagtttagatgaaaatagttccagtagtttgtacatctggattgggcgtgatgtgcaatggaaggaaagtttagatcaagtgatcaacaatgattccatgtgtgaagataatcatgtccattgggagaaagttggacgcggttttattattcagaagggcctggccaatagctctctagttcagatagtgaaagaaggtgaggaacctgagcagcttcttaagcatctgccgcgtttctcatttgacaaggcattagatgttgggatcaagtaggttttgataaaactgccgcggataccatctgaggtatgcaaaatccttgctttagtccttctggcaaggatctttggttagtgagcatcccaagcagtaaaagtccaaggtttctgcttgtgtgatgttgaatgatacaaagagaggattagatttctctcgtcgaaggacatgtacagggaagaagttgctgtataggaggagttgataagtatatatactactcttgttgaaaaataagtatactggtcccttttccctatctataccatccaacaacattcagtaacaaaaggtgtaatgtaatagtccctgcattgggacatttagcattgttacatacccaaattctctcaagtgttttctatcataaattgttcaatgtagattggggcttctttggctccayagattatt

SEQ ID NO: 72 - DNA, 2199 bp, Solanum lycopersicum
ctcgtgcccaaagatgttgagtgagccaggagctgaaggactcgattctcgtggagccttccttgttcttattccttctgttatatacgtgtggatagggaagcattgtacctcggtaatgtcagataatgccagggctgcagcctttcaggtaatccgctatgaaaaggcccaaggtcctgtcttaattatcaatgaaggcaaagagccttctgatttttggagtgcgattagtcaggaaagcttcttttctggtggttgtggcaaagaaaagaacaaggtggaagccagtttattagctgaaaatgacttaattactgataatatcagccagtgtattggtcaaaagaatgaatatgatcttgattttgaaattttctgcaaagcactcgccggtggtgttgttccaccttttccattgtcaggtactgaatctgagacatgtcttcccgcaagacagaatggatggagtagattgagacggaagttttccagtggaataatgaaagaatttatcacagcttccaagttatacagtcatactggcataacaagtcctgtacttgataagatagacaccattaaagaactctctcctgctttgccttcatcaccttcaagtcctcagtgtggatcaccagattctttctcttcttatgcaaccagtagtccaagttggacaaaggatccttgtagagatgtggaaaaccctggtcttgatacagagcctgtgtcgccatctccttcattcagctcacttgattctctctcttgttttcttgktagtaaaccaaagtytaatgccacatccccgtcactctcacctksracctcagattactccagtkctttcaccttttctccctcctcttccaattggtctgacttggcatacctatctgcacagccttcacccacgagatttgaacatgaggatcctaattttgtgaagaatgatttcttcaaagtaagttcatctttactttgtaaaggatcaccctttccagcagcagaggaagcatttccaaccagtcgtgctcttagacgggcaaacagttgtttacagtacagagaaacttccccttcactagcagagcgtagaggcagtcatcctcctcctatgatgatgttacgttccaatgatgattccgctcaaatttcagtgaaattggtgagaacatcatcattttctcttcctaattttgaagatgatacaatgaagtgtgttgagtgtgacagccttaatgacggagattttgttgatactagtaaagaggcgctaatgttagatgctgagaattcgattactgacaatcaactccaaaatggagttcaacctgtagatgatgtatctggcagtttcaatgaccgtccaattggcattcccatccgagttgcagaaacaactgatttaggtctttaccagtggccttctatgcataaattaggcttgtcttctgtggttttcgattcaaggtccgtttatatcatagtcattcctgacttgagtttagatgaaaatagttccagtagtttgtacatctggattgggcgtgatgtgcaatggaaggaaagtttagatcaagtgatcaacaatgattccatgtgtgaagataatcatgtccattgggagaaagttggacgcggttttattattcagaagggcctggccaatagctctctagttcagatagtgaaagaaggtgaggaacctgagcagcttcttaagcatctgccgcgtttctcatttgacaaggcattagatgttgggatcaagtaggttttgataaaactgccgcggataccatctgaggtatgcaaaatccttgctttagtccttctggcaaggatctttggttagtgagcatcccaagcagtaaaagtccaaggtttctgcttgtgtgatgttgaatgatacaaagagaggattagatttctctcgtcgaaggacatgtacagggaagaagttgctgtataggaggagttgataagtatatatactactcttgttgaaaaataagtatactggtcccttttccctatctataccatccaacaacattcagtaacaaaaggtgtaatgtaatagtccctgcattgggacatttagcattgttacatacccaaattctctcaagtgttttctatcataaattgttcaatgtagattggggcttctttggctccacagattcttca

SEQ ID NO: 73 - DNA, 1485 bp, Sorghum bicolor
gcacgaggcaacaataacagcacaagcagtgcaagcagcacgggaagcactaatagcagtgctctctacaaagttgatcatgaagcggattgtctggattatgagatcctgtgggaagacctcgtcattggagaacaaataggtcaaggctcttgtgggacagtataccatgctttgtggtatggttcggatgtggctgttaaagttttctccaagcaagaatattcagaagaagtgatactgacctttcgacaagaggtatcccttatgaagaaactacgccatcctaacatactgctcttcatgggtgcggttacatctccacaacgcctttgtattgtaacagagtatctccctcgtggaagcttgtttcgcttacttcaaaagagtgctaccaagttggatgtgagacgacgtgttcacatggctttagatattgcaaggggcatgaattatcttcaccattccagcccacctatcattcatcgagatttaaaatcatctaatctgttgggtgacaggaactggactgtgaaggtggcacactttggtctttcacgtctcaagcgtgaaactttcttgacaacaaaaacgggaaaaggaacaccgcaatggatggcgccggaggtgttgcgcaatgaaccttccgatgagaagtctgatgtgtatagttatggggttatcctgtgggaacttgttactcagaagataccgtgggaaaatctgaactcgatgcaggtcattggtgcagtaggttttatgaaccaaaggttggatatcccagatgaagtagatcctcaatggaaatcaattatcctgagctgctgggaaagcgacccacagcaacggccgtcattccaagagcttctggagaggctccgagagctgcagaggcattacgccatccagcaccggaacacaaagaacagcatcgaggagtgacgaatgcaatgcaactcccagagcgcggtgggctttgctttgaagcattttgcgagtgaccaagctgagtgagcggcatgtgtcagatctcgagaagggcctgaacctcctgtactgtatggttttgcttcgccgaaacagctaaggctggaagaagtttgttgtacagacgagggtaccttctgtcttctttggtttttcctttcctccccagggcaattgtgactgtaatttctgggtgctgacagcaaaggtagtagggtagcgagtgagtagtgactgagctccggattgctggcgcctttgggttcttctgattcgtggcaatgcaaatgcgtggttaacaataacatccaatccgggcttgagttttctggcaagggcatgatgatctgtaggttgtttgttctgagtttctgacaacagtggtgtattgtatacatgtgatcgattgtgatcatgcgtgagtttaatcgatgtactcgtgaaatcgactcttttttgcttcattcacataatcggtcgtcagacttgcagtcagga

SEQ ID NO: 74 - DNA, 3229 bp, Sorghum bicolor
ccattatttattactagtattattttattcaatctccatctggatgcgtgtgtgtgacttgtgagagagacagattccacagcaatttgctcctcttccacgcacagcccaaggcaagaactgctccccggaaaaagatcgtattttcagccggtttctgtccggcaaatcgctgccggagatcttagaaccggaaggctcgaagtttctgctccgtttgcgtcgaatctgcctcgggaagcggagaaaggagcggcctttcgagctcgtaggggccgtccctcagaaggctagaggggacgcggcggcggcggtggcggcggcggcagctctagggcgctcgtggaagtcggtgatgccggtttgaggtcaaggcggccccggtggttttgaggaagccgggcggggatggactccagcggggaggaactcctgaagaagatccgggagctggaggttgggcaggcgcagctcaagcaggagatgtccaagctaatacccggcgccggggagcggcgacgctcgcaatccgtctcgccgcggcgcggcgcgccggtgccgccgccaccaccggccaaggggaaggcgggggcgccaggtaggcggctgtccgggggttttgagggcgggcagcgtgcgtgggcccgtgggtcggcgtcgttcccgcactcatcgccgctgcagcgggagggccgcgccgcgggcgctggagacgctagcaccagcgctaggctgccggagaggcagtactctagggtgctgcagtcactggggcagtccgtccacattcttgacctcgacgggaggatcatatactggaatcagtctgcggagaatctgtttggctatcctgcatcagaagcccttggtcaggatgccctaatgcttctggttgattcccatgaccacaatgctgtaaatgacatcttccgacgtatttctatgggtgaaagttggactgggaagtttccagttaagaacaggcaaggagatagattttcagctcttgccaccaacacacctttctacgatgaggatggcagcttggtgggtatcatttgtgtttcaagtgattcccgcctcttggagcaaatattttgtaagcctccaacctctgcaaggccccagtcagaatcatctaggacatcttgtgacgggagttgcagcaacactagtcgcagaatcaatttgttgaacaaaagtccttttgatcctcagctacccctgcaaagcactttagcttccaagataacgaatttggctaccaaggtcacaaataaagttcgttctcgggtcaggacagatgagaatggcatagagcgggaaggtggcagtggtgagagtcattgctcggatcgtggtgcaaaggaagagccaacatctagtggaacaaatacaccaagaggggatgcaccacatggtccctttgctacagaagagaactcccctgggaaatcaatgaacccaaacagcgatgaatcagaaggaaaaatagctctgcacaagatttggagtacaaaagcagaggcactactgaacaagaaagggatatcatggccttggaaagggcgcgaaaatgagggacctgatgaaaggaatcatgtgatattgccgtggttgcatggtgaccaagagaatggtacgaatcatcagaaggtttctgattctagcatagttccagatgcccaaggcgctgaacacaaccaacctaacaaaaatgaggcatcaggttcctggtcctctttcaacaataacagcacaagcagtgcaagcagcacgggaagcactaatagcagtgctctctacaaagttgatcatgaagcggattgtctggattatgagatcctgtgggaagacctcgtcattggagaacaaataggtcaaggctcttgtgggacagtataccatgctttgtggtatggttcggatgtggctgttaaagttttctccaagcaagaatattcagaagaagtgatactgacctttcgacaagaggtatcccttatgaagaaactacgccatcctaacatactgctcttcatgggtgcggttacatctccacaacgcctttgtattgtaacagagtatctccctcgtggaagcttgtttcgcttacttcaaaagagtgctaccaagttggatgtgagacgacgtgttcacatggctttagatattgcaaggggcatgaattatcttcaccattccagcccacctatcattcatcgagatttaaaatcatctaatctgttggttgacaggaactggactgtgaaggtggcagactttggtctttcacgtctcaagcgtgaaactttcttgacaacaaaaacgggaaaaggaacaccgcaatggatggcgccggaggtgttgcgcaatgaaccttccgatgagaagtctgatgtgtatagttatggggttatcctgtgggaacttgttactcagaagataccgtgggaaaatctgaactcgatgcaggtcattggtgcagtaggttttatgaaccaaaggttggatatcccagatgaagtagatcctcaatggaaatcaattatcctgagctgctgggaaagcgacccacagcaacggccgtcattccaagagcttctggagaggctccgagagctgcagaggcattacgccatccagcaccggaacacaaagaacagcatcgaggagtgacgaatgcaatgcaactcccagagcgcggtgggctttgctttgaagcattttgcgagtgaccaagctgagtgagcggcatgtgtcagatctcgagaagggcctgaacctcctgtactgtatggttttgcttcgccgaaacagctaaggctggaagaagtttgttgtacagacgagggtaccttctgtcttctttggtttttcctttcctccccagggcaattgtgactgtaatttctgggtgctgacagcaaaggtagtagggtagcgagtgagtagtgactgagctccggattgctggcgcctttgggttcttctgattcgtggcaatgcaaatgcgtggttaacaataacatccaatccgggcttgagttttctggcaagggcatgatgatctgtaggttgtttgttctgagtttctgacaacagtggtgtattgtatacatgtgatcgattgtgatcatgcgtgagtttaatcgatgtactcgtgaaatcgactcttttttgcttcattcacataatcggtcgtcagacttgccgtcaggattttttt

SEQ ID NO: 75 - DNA, 2079 bp, Arabidopsis thaliana
tctcatctctctctctctacctttctctcacacaaagagttttttcttttaagacaaaaactctttcaaggttttaaatctttgaaaaaattctctaaacctaaaagtgatcaatgaagattcggaacagccctagttttcatgggggtagtggttacagtgtctttagagctcgtaacttaacattcaagaaagttgtgaagaaagtgatgagagaccagtcaaataatcaattcatgattcagatggagaacatgataagaagaattgtccgagaggagatacagcgtagtcttcaaccttttctctcttcatcatgcgtctcaatggagcgatctcgctcagaaacgccatcgtctcgctcacgattgaagctgtgcttcataaactcgccgccatcatcgatattcacggggtccaagatcgaagctgaggatggttctccgcttgtgatcgagctcgtggacgccaccacaaacactctagttagtacgggaccgttctcgtcttctcgggtcgagctcgtgccgctgaacgctgatttcacggaagaaagctggaccgttgagggatttaatcggaatattctcacgcaacgtgaagggaaacgtccgttgctcactggagacctaacggtgatgcttaaaaacggtgttggagttataaccggagatatagctttctcggataactcgagctggactaggagtcggaagttccggttaggtgctaagttgaccggagatggagccgtggaggcgagaagtgaagcttttggatgtagagaccaacgaggagaatcttataaaaaacatcatcctccgtgccccagtgatgaggtttggagactagagaaaatcgcgaaagatggagtttcggcaacgcgtttggctgaacgcaagattttaaccgtcaaggattttcgccgtttgtatactgtaaatcgaaatgagttacacaacataattggtgcaggggtctcaaagaaaacatggaacacaattgtatcacatgccatggattgcgttttggacgaaacagagtgttacatttacaatgcaaacactccgggcgtaacacttctcttcaactctgtttatgagttgataagagtgtcattcaatggcaacgatatccaaaaccttgatcagccaattctagaccaattaaaggccgaagcttatcaaaaccttaaccgcattacagcggttaacgataggacctttgtgggtcatccacaaaggtccttacagtgcccgcaagatcctggatttgtcgtaacatgttctggatcgcagcacatcgactttcaaggaagtttggatccatcaagctcttcgatggctctttgccacaaagcttcaagctcaacggtccaccctgatgtcctgatgagttttgataactcatcaaccgcgaggtttcatatcgacaaaaagttcttaccgactttcggaaacagcttcaaagtaagtgaactcgatcaagtacacggaaaatcacaaactgttgtgacaaaaggttgtatagagaataacgaggaggatgagaacgcgttttcttatcatcaccatgatgacatgacctcaagctggtcacctggtacgcaccaagccgttgaaacgatgtttcttaccgtgtctgagacggaagaagctggaatgttcgatgttcattttgcaaacgttaatttgggatctccaagagccaggtggtgtaaggttaaggcagctttcaaggttagggcagcttttaaggaagtccggagacacacaactgccagaaatccgagggaaggcttgtaagaactcttgcctacctattaaaatcagcggtttcttgcgttgcacgataaatgtgtatatatatttgtgaatagggttagataaatggatcccggccattgagttacggggattagcctttgcgtatatcaaagtatttttttccctgggtaagtatagctgtggcacagggtttgtaagttgtaaccatatgccgtataagaatcagaggtttcttgttgtacacgaaagctatgtataaataaaagctatgtatatatgtttttttctacca

SEQ ID NO: 76 - DNA, 2078 bp, Arabidopsis thaliana
tctcatctctctctctctacctttctctcacacaaagagttttttcttttaagacaaaaactctttcaaggttttaaatctttgaaaaaattctctaaacctaaaagtgatcaatgaagattcggaacagccctagttttcatgggggtagtggttacagtgtctttagagctcgtaacttaacattcaagaaagttgtgaagaaagtgatgagagaccagtcaaataatcaattcatgattcagatggagaacatgataagaagaattgtccgagaggagatacagcgtagtcttcaaccttttctctcttcatcatgcgtctcaatggagcgatctcgctcagaaacgccatcgtctcgctcacgattgaagctgtgcttcataaactcgccgccatcatcgatattcacggggtccaagatcgaagctgaggatggttctccgcttgtgatcgagctcgtggacgccaccacaaacactctagttagtacgggaccgttctcgtcttctcgggtcgagctcgtgccgctgaacgctgatttcacggaagaaagctggaccgttgagggatttaatcggaatattctcacgcaacgtgaagggaaacgtccgttgctcactggagacctaacggtgatgcttaaaaacggtgttggagttataaccggagatatagctttctcggataactcgagctggactaggagtcggaagttccggttaggtgctaagttgaccggagatggagccgtggaggcgagaagtgaagcttttggatgtagagaccaacgaggagaatcttataaaaaacatcatcctccgtgccccagtgatgaggtttggagactagagaaaatcgcgaaagatggagtttcggcaacgcgtttggctgaacgcaagattttaaccgtcaaggattttcgccgtttgtatactgtaaatcgaaatgagttacacaacataattggtgcaggggtctcaaagaaaacatggaacacaattgtatcacatgccatggattgcgttttggacgaaacagagtgttacatttacaatgcaaacactccgggcgtaacacttctcttcaactctgtttatgagttgataagagtgtcattcaatggcaacgatatccaaaaccttgatcagccaattctagaccaattaaaggccgaagcttatcaaaaccttaaccgcattacagcggttaacgataggacctttgtgggtcatccacaaaggtccttacagtgcccgcaagatcctggatttgtcgtaacatgttctggatcgcagcacatcgactttcaaggaagtttggatccatcaagctcttcgatggctctttgccacaaagcttcaagctcaacggtccaccctgatgtcctgatgagttttgataactcatcaaccgcgaggtttcatatcgacaaaaagttcttaccgactttcggaaacagcttcaaagtaagtgaactcgatcaagtacacggaaaatcacaaactgttgtgacaaaaggttgtatagagaataacgaggaggatgagaacgcgttttcttatcatcaccatgatgacatgacctcaagctggtcacctggtacgcaccaagccgttgaaacgatgtttcttaccgtgtctgagacggaagaagctggaatgttcgatgttcattttgcaaacgttaatttgggatctccaagagccaggtggtgtaaggttaaggcagctttcaaggttagggcagcttttaaggaagtccggagacacacaactgccagaaatccgagggaaggcttgtaagaactcttgcctacctattaaaatcagcggtttcttgcgttgcacgataaatgtgtatatatatttgtgaatagggttagataaatggatcccggccattgagttacggggattagcctttgcgtatatcaaagtatttttttccctgggtaagtatagctgtggcacagggtttgtaagttgtaaccatatgccgtataagaatcagaggtttcttgttgtacacgaaagctatgtataaataaaagctatgtatatatgtttttttctacc

SEQ ID NO: 77 - DNA, 1236 bp, Arabidopsis thaliana
cctttctagaaacgattctttttttaataccccacacaccctcagatctattatcaaccgttggattacgtggacaagtccaatgccactcgtatttttaaccattcctcacactcctcaacgtgatgtgaagatactttgctgtttcataacgtcataaagaacagtgacaggcgaaatttctcaagaaagcaaatcggaagaactcacaaaaaaaactaagatggagacagagaagaaaaatagcaaggaggtagcgctaaaacacctagcgttcgtgagaattgcaacgatccatattctggcttccgtctcaaatctctacgaatacgctaaacaaaactccggtcctctcaaatccgccgtggaaaaggtcgaaggagccgtcaccaccgtcgtcacccctgtctatcagaaattcaaagatgttcctgattctctcctggtctttctagatcacaaggtgggtgaagtttcgtacaagtttgatgagcatgctcctccaatggctaagaaagtggtgaatcaagcacatgtattgatctacaaggcgacagagaaagctcaaagctttgtgaaagaggctcgtaccggtggtcccaaagctgcgtttaactatgctgcaactgagtacaagtttttcgttgtgaccaactcggttaaagtctgggctaaacttaaccagtataaaccaatccatgcaatgggtgacaaagctttgcctgtggctgcacacttttccagtcggtacaacgatttggtgactgatatgactaatatgggttactctttggttggttatcttccgttggttcctgttgatgacattgttaaggcttatgaaaaggaagatgcaaggagaaagaaaggaggggatacggctggaaagaaaggagagactactgatgcggctgatggtgataaatcatcgtctgattcggagtaggattgagacattttgtgatttgttgctgctttggaaagtttggtttgttgggttttggttatgtgtgtaaatgatcttaggacctctctttttttcttctatcacagaactttgaactagtgttttatctcttggtgctgtgaaaatgtactacgtgtgtttcgatctttttaaacaaggatgggtagtgttagctacataacttcgaagaacatgaaaaaattatcacattttgagaaattgtatcagtatcaaaaatggaggagatggagaatcaaaacaactttact

SEQ ID NO: 78 - DNA, 1234 bp, Arabidopsis thaliana
tttctagaaacgattctttttttaataccccacacaccctcagatctattatcaaccgttggattacgtggacaagtccaatgccactcgtatttttaaccattcctcacactcctcaacgtgatgtgaagatactttgctgtttcataacgtcataaagaacagtgacaggcgaaatttctcaagaaagcaaatcggaagaactcacaaaaaaaactaagatggagacagagaagaaaaatagcaaggaggtagcgctaaaacacctagcgttcgtgagaattgcaacgatccatattctggcttccgtctcaaatctctacgaatacgctaaacaaaactccggtcctctcaaatccgccgtggaaaaggtcgaaggagccgtcaccaccgtcgtcacccctgtctatcagaaattcaaagatgttcctgattctctcctggtctttctagatcacaaggtgggtgaagtttcgtacaagtttgatgagcatgctcctccaatggctaagaaagtggtgaatcaagcacatgtattgatctacaaggcgacagagaaagctcaaagctttgtgaaagaggctcgtaccggtggtcccaaagctgcgtttaactatgctgcaactgagtacaagtttttcgttgtgaccaactcggttaaagtctgggctaaacttaaccagtataaaccaatccatgcaatgggtgacaaagctttgcctgtggctgcacacttttccagtcggtacaacgatttggtgactgatatgactaatatgggttactctttggttggttatcttccgttggttcctgttgatgacattgttaaggcttatgaaaaggaagatgcaaggagaaagaaaggaggggatacggctggaaagaaaggagagactactgatgcggctgatggtgataaatcatcgtctgattcggagtaggattgagacattttgtgatttgttgctgctttggaaagtttggtttgttgggttttggttatgtgtgtaaatgatcttaggacctctctttttttcttctatcacagaactttgaactagtgttttatctcttggtgctgtgaaaatgtactacgtgtgtttcgatctttttaaacaaggatgggtagtgttagctacataacttcgaagaacatgaaaaaattatcacattttgagaaattgtatcagtatcaaaaatggaggagatggagaatcaaaacaactttact

SEQ ID NO: 79 - DNA, 1688 bp, Triticum aestivum
ccaaatacatatacttggcagacatgatgcgcttcatgaggcaggaggaagccatcaaagctatgcatctttttgaaggagcacaggagcactgcagggtcagcaagaggtctctgaagaactgggtggtgaatgcatttagagagcgcaaagctcttgccctaacacttaacgacacaaaaactgcagttaacaagctcaaccagatgtgcaatgtcgttgttggcctcatagtgtctgctctctggcttcttattctgggcatagccacaacacatttctttgtcttcatcagttcacagcttcttgtggcagtttttgtgttcgggaatactatgaagacaatttttgaggcaattattttcttattcgtgatgcatcctttcgatgtcggtgaccgctgtgagattgaagaagttcaggttgttgtggaggaaatgaatatcatgacaacagtcttcctacgttatgataacctgaagatctattatccgaacagtgtgctggccaccaagccgatttttaatttctacaggagtcctgatatgggagaaggaattgacttctctattcatgttgccacgccggtggaaaaactagctctcatgaaggaaagaatactacgttacattgacggtaagaaggagcattggtacccgggtacgatggtggtcctccgagatgtagatgacaccaacaagctgaaggtatccatatggctccggcacacgctcaacttccaggacatggggatgaggttcgtgaggagggaactggtgctccaggagatgatcagagtgctcaaggacctcgacatcgagtaccggatgttgccgctcgacgtgaacgtgcggaacgtgccccctcttcagtccacaaggatgccgacgacatggaactatgcctgaagcggcgaacgcgagggctagaagatacagcagctacctgcaggagcctggcagcagcaactatagcggatagccattagctgttagttagtgtgcctgctgtgatgagtgtgttgtgtagtataacaagctttcgtgcacttgatgataggcaatacagatagtggccattggaaatgttgaaagcggcctgacgttgccgctgcaacttttgttgaaagcacgctgcttggcccagctctgaatatcttctggtgatggaacgagacggcagcttcagccgtctcctccacgcacggtaggccagcgtcgagtggaaacacgacgccgtttcgcctcttacccggcaattctgacgccgactgctcatggcgaacggtgcgagcgggacggagggggaaggaagggcgcaatcacgctgctgtggtgtgaagtcgaattcgtgggcgttgcggtgggtcgtcttctgaagcatcttacgcaaaggcgcgcctcggtctggtggtgcccacgaagcaccgccgcctgattcttagttggagtcgtaatcgtgcgagccatggtggctgccatccggtcccatggaggctgccgatgcccgtgttgtaagagcgactggtctggtggtgttcgagcaggggatgtgggtttcagaccggagcttgagaggcattgagaggctagaagaggaggggctcattgatgctgagctttgctgtcgtagggcctctctgctagctgaactcaatgaaatccgcacgaacgaagagtgaactcaat

SEQ ID NO: 80 - DNA, 2062 bp, Triticum aestivum
gcgcgccggcgcagacatcccgaaagagctgcatcccgccttgccaaccaagaacctgtcggggcaaaggggcacccgggtctcgggtttgatctccaggggaatcaatccgctgtccaaggagaagaagcggcgtgaggctgatgaagggatcaccattgacaagctccataggctcaaccagagaaacgtctcggcatggaacatgaagaggctcgtgaagattgttcgtttcgagacgctcgccacaatggacgagcagatccagcaggcaactacaggrgasggsgmygagtcwgsgacacagattcrcasygaatatgaggcgcagctsgccgccaagaagatcttycayaaygtrgcsaarcctggatccaaatacatatacttggcagacatgatgcgcttcatgaggcaggaggaagccatcaaagctatgcatctttttgaaggagcacaggagcactgcagggtcagcaagaggtctctgaagaactgggtggtkaatgcatttagagagcgcaaagctcttgccctaacacttaacgatacaaaaactgcagttaacaagctcaaccagatgtgcaatgtcgttgttggcctcatagtgtctgctctctggcttcttattttgggcatagcgacgacacatttctttgtcttcatcagttcacagcttcttgtggcagtttttgtgttcgggaatactatgaagacaatttttgaggcaattattttcttattcgtgatgcatcctttcgatgtcggtgaccgctgtgagattgaagaagttcaggttgttgtggaggaaatgaatatcatgacgacagtcttcctacgttatgataacctgaagatctattatccgaacagtgtgctggccaccaagccgatttttaatttctacaggagtcctgatatgggagarggaattgacttctctattcatgttgccacgccggtggaaaaactagctctcatgaaggaaagaatactacgttacattgacggtaagaaggagcattggtaccctggtrcgatggtkgtcctccgagatgtagatgacaccaacaagctgaaggtatccatatggctccggcacacgctcaacttccaggacatggggatgaggttcgtgaggagggaactggtgctccaggagatgatcagagtgctcaaggacctcgacatcgagtaccggatgttgccgctggacgtgaacgtgcggaacgtgccccctcttcagtccacaaggatgccgacgacatggaactatgcctgaagcggcgaacgcgagggctagaagatacagcagctacctgcaggagcctggcagcagcaactatagcggatagccattagctgttagttagtgtgcctgctgtgatgagtgtgttgtgtagtataacaagctttcgtgcacttgatgataggcaatacagatagtggccattggaaatgttgaaagcggcctgacgttgccgctgcaacttttgttgaaagcacgctgcttggcccagctctgaatatcttctggtgatggaacgagacggcagcttcagccgtctcctccacgcacggtaggccagcgtcgagtggaaacacgacgccgtttcgcctcttacccggcaattctgacgccgactgctcatggcgaacggtgcgagcgggacggagggggaaggaagggcgcaatcacgctgctgtggtgtgaagtcgaattcgtgggcgttgcggtgggtcgtcttctgaagcatcttacgcaaaggcgcgcctcggtctggtggtgcccacgaagcaccgccgcctgattcttagttggagtcgtaatcgtgcgagccatggtggctgccatccggtcccatggaggctgccgatgcccgtgttgtaagagcgactggtctggtggtgttcgagcaggggatgtgggtttcagaccggagcttgagaggcattgagaggctagaagaggaggggctcattgatgctgagctttgctgtcgtagggcctctctgctagctgaactcaatgaaatccgcacgaacgaagagtgaactcaat

SEQ ID NO: 81 - DNA, 2147 bp, Arabidopsis thaliana
ctctaaaatctctcactttcctaaacagagagaccccttatgagttttctcctcctcctcctcctcttccttcctcatcccagaaatttccgatttcactttcacatctccctctctcttacaactctctatccgtagtttcagtttcgtcctagaatttcttttcttgtctgttccagatgaaattgtgagttctccgagttatatgcatccgttagaatcaaagcggtaatcaaaagcagaatttagaggattgaaaaagatggttttggggtgtttccctttgaaaagcaagaagaaacgtggctctgtttctatgaagcggttggatcttgaagaaagcaagccaactgctttacctgagccaccaaagattccaagtcgtaatttacaatcagctcctccgagtttcagaactcgtgtgaagccaattcaatctaacaacggtggaaccggagagatgagtagccgagcaagagtcatgtctgctccgtcaagcatccacggtgcagcggaacgggatttgcttgctggtgtttaccacgacgagcaagatgaacaaccaagagatccacgtacttctactaaagaatctagccctcaaccacttccgttaccgtcaccaagaactggttcttcattgaagaattggggaagctttaagtcgtttaacggaagcagcggtcggttatcatcatccgcagctgtatctggacctttacctttgccacctagcgggtcagttaggagcttttcatatgatgaagtaatggctgcgtgtaacgctttttcttcagaccgatgtgtcatggaaggtctttcatctgttatgtacatggcttcctttggtgatgaggcttcgacctcaggtttaaagaaggttgacgcaactgttgtacgacttcacgtaattactcagagtattagggagttcattaatgaagtcaacacattggcgtcgctgcaacaccagaacctttgtaagctggtaggctatcatgctcgtgacggttctgacacaagaatgttggtgtacgagaggcttgctctgggcagcttggaccgtttactgcatgggagatcagatgggcctcctcttgattggaacactagaatgaagattgcactatgcgcagctcagggtctaaccttcttgcacgaagaaggcccttttcaggcaatgtacaatgaattttcgacggcaaatatccaagtcgataaagatttcagcgccaagctatcaggatacggttgtgcaggccatgcgcctgagacagagacatctaatagttcggcacttgctaatctctctgtcgagactctagagagagggcttttgaccccgaagagcaatgtgtggagctatggaatagttcttcttgagatgttaacgggtcggaaaaatatggacgggtcttacccgaaagaagagaggaacttagtgaaatggagcagagcttttctagcagatgattgcaggctctcgcttataatggatcctcagcttaaaggtcggtttccggcaaaagcggctaggagcatagcagatatagcacagaaatgtctgcaggtggagccttcagagcgtccaaccatgagaaacatcgtggatcaactcaagatcatacaggacatgaagtactcgtgtaggttcccattgagagaacccgcaccggtcgtggcaaggaaacatatgggaagatcaagcagtctcaacacgattatttggaccccggcatcagtgccaccaaggtcgagtttttcaccgtcacctccaccacgacgaccgtctgtctcacccacaaggggacggacgctcgtgtttcccccagtgtttccgccgcgagcgtgttcatctttggaggaaatggctcgggaagaggttcgaagatcgtcttcagccagtggtaggagaactagcctcgaagggttttgatttgttcatatctctcttctttcttctttttcctatttgtttttaatttttggcgttgatttgttttttggattccaaatataaaaaattgtttttttctttttcttttgttgtttatgaatccggacgtcgatagagagggtttgtgatgttttgtacataataatcaacatttcttctttcacattaaaaagagatccaagtattgtgt

SEQ ID NO: 82 - DNA, 1664 bp, Sorghum bicolor
aagagagggctgcctgcctatcctccaattccattccatcccggcggtgccgtcccctccctcttcctcttcagcgcagcgcaggaactagctcagctcgcagctccatcgsccgatggtacagtacagtgktgacaagatgaagacctctctcttgctcctgccgctgttcatcgcactcctctctgcaaccagccctctcccatcagctgatgcgctgaacgtgaaaggccgcctggtgaagtccaagacsttcctgtccccgcccatcttcctgcgcccgggcgacgtcgccgacaagatctactacgacatcgccttcccgagaggccacctggcgttcaagagcttcaacggcgaggtggtcgacgagcacggcgtgccggtgcctctccacgagacgtacctccaccactgggtcgtggagccctactacgcggccaaggacgcctccaccgcggcggcggagggccgcccgcggatgatcccggcgaggaactccggcgtgtgcaaccacacgctggggcagtactacgggctcgggtccgagacccggcgcaccgccacgtgggtgcccgacccttacggcatcgagatcggcgaccccgacgcggcgccggaagggtacgaggagcggtggatgctcaacgtgcacgccatcgacacgcggcgcgtggtcgacaagctcgcgtgcaccgagtgccgctgcgacctgtacaacgtcaccgtggaccagtacggccgcggcatcgaggacggctacgccggcggcctgcgctgctgctacgacgagacgcggtgcgcgctggaggagcgaggaaggctcctcgtgaacgccgacgaggaggcgccgcccaggaaggtgttcytgcgctacaccgtgatgtggcaggactggagcgacgcggcggtgctgcccgtgaagatctacatcttcgacgtcaccgcgtgcaaggtggagtacgacgtggacgagtgcgccgccgggaacgacaacggcggcggcggcgagtgcgtccacgtgcagacggccacgcaggtgctgccgcggggaggcgacgtcgtgttcggcgtcgcgcaccagcactcgggcggcatcgccgcgtccctccacggcgaggacgggcgcctgctgtgcgagtcgacggccacctacggcgacggggaggaggccgggaacgaggcggggtacatcgtcggcatgtccacgtgctacccgaagccgggcgacgtgaaggtgcgcgacggcgaggctctcaccgtggtgtccaggtacagcagcgagcgccggcacacgggcgtcatgggcctcttctacatcctcgtcgccgagcagcaggtgccggctgacggcaagccgccgggcctgtgcttcagcttcccggtctcatggtgtctaccgtcatggctgtcgagcaacatgtgagagctctttgttgttgaatggttatgactagtagaaataaacaatgttctagtagcaagcagccaagcatgcaggccattgatgagtcgtcgtgctatatatcttgaaagaaccatcagcaagagtctcctttgatagatgcatgacttgtatgcgtttgtataacacactatagtaagctgggttttgcagatgtacaatctcttgtacaaaaaacagaaataaatataatgagatt

SEQ ID NO: 83 - DNA, 1671 bp, Sorghum bicolor
aagagagggctgcctgcctatccatccaattccattccatcccggcggtgccgtcccctccctcttcctcttcagcgcagcgcaggaactagctcagctcgcagctccatcggccgatggtacagtacagtgttgacaagatgaagacctccctcttccttctgccgctgttcgtcgcactcctctctgcaaccagccctctcccatcagctgatgcgctgaacgtgaaaggccgcctggtgaagtccaagacgttcctgtccccgcccatcttcctgcgcccgggcgacgtcgccgacaagatctactacgacatcgccttcccgagaggccacctggcgttcaagagcttcaacggcgaggtggtcgacgagcacggcgtgccggtgcctctccacgagacgtacctccaccactgggtcgtggagccctactacgcggccaaggacgcctccaccgcggcggcggagggccgcccgcggatgatcccggcgaggaactccggcgtgtgcaaccacacgctggggcagtactacgggctcgggtccgagacccggcgcaccgccacgtgggtgcccgacccttacggcatcgagatcggcgaccccgacgcggcgccggaagggtacgaggagcggtggatgctcaacgtgcacgccatcgacacgcggcgcgtggtcgacaagctcgcgtgcaccgagtgccgctgcgacctgtacaacgtcaccgtggaccagtacggccgcggcatcgaggacggctacgccggcggcctgcgctgctgctacgacgagacgcggtgcgcgctggaggagcgagcagggctcctcgtgaacgccgacgaggaggcgccgcccaggaaggtgttcctgcgctacaccgtgatgtggcaggactggagcgacgcggcggtgctgcccgtgaagatctacatcttcgacgtcaccgcgtgcaaggtggagtacgacgtggacgagtgcgccgccgggaacgacaacggcggcggcggcgagtgcgtccacgtgcagacggccacgcaggtgctgccgcggggaggcgacgtcgtgttcggcgtcgcgcaccagcactcgggcggcatcgccgcgtccctccacggcgaggacgggcgcctgctgtgcgagtcgacggccacctacggcgacggggaggaggccgggaacgaggcggggtacatcgtcggcatgtccacgtgctacccgaagccgggcgacgtgaaggtgcgcgacggcgaggctctcaccgtggtgtccaggtacagcagcgagcgccggcacacgggcgtcatgggcctcttctacatcctcgtcgccgagcagcaggtgccggctgacggcaagccgccgggcctgtgcttcagcttcccggtctcatggtgtctaccgtcatggctgtcgagcaacatgtgagagctctttgttgttgaatggttatgactagtagaaataaacaatgttctagtagcaagcagccaagcatgcaggccattgatgagtcgtcgtgctatatatcttgaaagaaccatcagcaagagtctcctttgatagatgcatgacttgtatgcgtttgtataacacactatagtaagctgggttttgcagatgtacaatctcttgtacaaaaaacagaaataaatataatgagattatatac

SEQ ID NO: 84 - DNA, 2092 bp, Oryza sativa
ccgaccacaccccgaatccccctccctttgcttttctactcctcaactccgctccactctccacccgggatggcggacgccacgcacgccgccgccgatggcggcgtcgccaccatcctcgcctccgccgacggcagggacttcctcctccgcaactccgccgacaaggtcaagatcagtagcatcaaggcaagcacagtggccctctacttctcggcctcatggtgcccaccatgcaggcgcttcacgcctaagcttattgaagcatacaatgagctggtctcccagggaaagagctttgaggttgtctttgtttcaggggatagtgatcaagacgcattcaatgcctactttgcaaagatgccttggttggcagtccccttctcagactccgaggctctcgccaagcttaatgaacgctataaggtgatgggtattccacaccttgtaatccttgatgcaaaatctggtgaaatttacactgaagatggagtggagcttgtgcatgagtatggtacagaagcttacccttttacaacagagaggatcaatgaattgaaggaacaggaaaaggcagctaaagataatcaaactattcatagtctgtttggtacacccacccgcgactacttaatcaccaacaagggagacaaggtgcccatctctgacctcgaaggcaagtatgttggtttgtgctttgtggtgaatggctatggtccagttgttcaattcacctcagtgcttgccaaaatatatgaaaaacttaaagcagttggggagaagtttgaagttgtaatggtatcattggacggtgatgaggaatcattcaatgagagttttgcagacatgccttggcttgccattcctcagggagataagatgtgtgagaagctggctcgttattttgagctcagtggccttcctatgcttgtcctgattggtcctgatgggaagacactgaatgacgatattgctgacataattgatgagcatggtccagatgcatgggaaggttttcctttcagtgcagagaagctcgaaattcttgctgagaaggcaaaagctaaagcagaatcacagaccctggagtcccttctggtcactggtgatttggactttgtccttgggaaagatggggcaaaggttcctgtatcagaacttgttgggaagactgtcctcctctacttttcagctaaatggtgccctccatgccgagccttcctgcctaaacttgtaaacgaatacaacaagatcaaggagaagcacaatgattttgagatcgtatttatttctagcgatcgagagcagagttcctacgatgagttcttctctggcatgccatggcttgctcttcctttgggagacgaaaggaagcaacaattgagtaagatcttcaaaatcactgggatcccttcgcttgtcgccattggtcctgatgggaagacagtgaccaaagatgcgaagaccccactggtggcccatggcgccgacgcttttccattcaccgaggagaagcttcaggagctggagaaggagaaggagaagaagatcaatgacatggcaaaggggtggcctgagaagctaaagcatgatctgcacgatcatgagcttgtgctgactcgctgcaccacgtatggctgcgatggatgcgacgagatgggcgactcatggtcctacaggtgcaaggaatgtgacttcgatctgcatcccaagtgcgcgctggaggagaagggcgatgtggagatgggagaggagaatgctgaggctgcccccgctgggtatgtgtgcgagggagacgtctgcagaaaggtctaaaggagttgttttgtttcccctggcttctttttatctctgtgccggttgaatcgtgcctgaatgtttgggatgtgaatcctatgtgatgagtataataaaacaatcgtctcctggttttgcttataatatgtttgggctggatgatacattggtatttgtggatattaaaatgagctgggtttggattaatgtgtgcaaaatcgtgtgtaattacgattgcggattggtagttgtcttgatctgcttgttattacagccttgaagcgtgaaaatagca

SEQ ID NO: 85 - DNA, 1942 bp, Oryza sativa
ccgccgaccacaccccgaatccccctccctttgcttttctactcctcaactccgctccactctccacccgggatggcggacgccacgcacgccgccgccgatggcggcgtcgccaccatcctcgcctccgccgacggcagggacttcctcctccgcaactccgccgacaaggtcaagatcagtagcatcaaggcaagcacagtggccctctacttctcggcctcatggtgcccaccatgcaggcgcttcacgcctaagcttattgaagcatacaatgagctggtctcccagggaaagagctttgaggttgtctttgtttcaggggatagtgatcaagacgcattcaatgcctactttgcaaagatgccttggttggcagtccccttctcagactccgaggctctcgccaagcttaatgaacgctataaggtgatgggtattccacaccttgtaatccttgatgcaaaatctggtgaaatttacactgaagatggagtggagcttgtgcatgagtatggtacagaagcttacccttttacaacagagaggatcaatgaattgaaggaacaggaaaaggcagctaaagataatcaaactattcatagtctgtttggtacacccacccgcgactacttaatcaccaacaagggagacaaggtgcccatctctgacctcgaaggcaagtatgttggtttgtgctttgtggtgaatggctatggtccagttgttcaattcacctcagtgcttgccaaaatatatgaaaaacttaaagcagttggggagaagtttgaagttgtaatggtatcattggacggtgatgaggaatcattcaatgagagttttgcagacatgccttggcttgccattcctcagggagataagatgtgtgagaagctggctcgttattttgagctcagtggccttcctatgcttgtcctgattggtcctgatgggaagacactgaatgacgatattgctgacataattgatgagcatggtccagatgcatgggaaggttttcctttcagtgcagagaagctcgaaattcttgctgagaaggcaaaagctaaagcagaatcacagaccctggagtcccttctggtcactggtgatttggactttgtccttgggaaagatggggcaaaggttcctgtatcagaacttgttgggaagactgtcctcctctacttttcagctaaatggtgccctccatgccgagccttcctgcctaaacttgtaaacgaatacaacaagatcaaggagaagcacaatgattttgagatcgtatttatttctagcgatcgagagcagagttcctacgatgagttcttctctggcatgccatggcttgctcttcctttgggagacgaaaggaagcaacaattgagtaagatcttcaaaatcactgggatcccttcgcttgtcgccattggtcctgatgggaagacagtgaccaaagatgcgaagaccccactggtggcccatggcgccgacgcttttccattcaccgaggagaagcttcaggagctggagaaggagaaggagaagaagatcaatgacatggcaaaggggtggcctgagaagctaaagcatgatctgcacgatcatgagcttgtgctgactcgctgcaccacgtatggctgcgatggatgcgacgagatgggcgactcatggtcctacaggtgcaaggaatgtgacttcgatctgcatcccaagtgcgcgctggaggagaagggcgatgtggagatgggagaggagaatgctgaggctgcccccgctgggtatgtgtgcgagggagacgtctgcagaaaggtctaaaggagttgttttgtttcccctggcttctttttatctctgtgccggttgaatcgtgcctgaatgtttgggatgtgaatcctatgtgatgagtataataaaacaatcgtctcctggttttgcttat

SEQ ID NO: 86 - DNA, 1182 bp, Zea mays
gcacgagccccggccctcctgtcgcccttgctgtctcgggagtcggggccccgtaaaaaaggcaaactcgaccccgcgaccgcttcctctgctcctctaggctctagtcctctcgcatccgcagcttccccagccagctagggtttgcagatgacgaccgcggcgcgccccacctgggcgccggccaagggcggcaacgagcaggggggcacccgcatcttcggcccctcccagaagttctcctcccgcgacctcgccgcgcacacctccctcaagccaagaaaagacggtcaacagacccaagaggagttacagaagaggaatctcagggaggaacttgaggaacgtgagcgcaagcactactcttccaaggataagtcctatgccgaagaaagagaccggcggaaaagctctagccatctactcttagaaggttcaaagagagagacagaggataagatagttccacgagaaatcgatgctgatgactccgatgtggagcctaaaagcgatgacgagagcgatgaagatgatgatgacgacgacactgaagctctaatggcagagcttgagaggattaagaaagaaagagccgaggagaagcttagaaaggagcggcaacaagcagaagaggaggccaagatgaaggaggctgaactgatgcggggaaacccgttgattaatatcaacaatgctggctccttcagtgttaagagaaggtgggacgacgacgtggtattcaagaatcaagcacgaggagagaccaagacaccgaaacggttcatcaacgacaccatcaggagtgatttccaccgtaaatttcttcagaggtacatgaagtgacgcttccgtcgttcacaattcagcctggagcccctcatcgttatcatgtttgtgtatgagcgaaagatcattattgtgttgttgtatgaaacaagagtgtaaacatatgtctactacttaacaaagttatgctgagcaatgcatatcctagttgaatgtgacaatgctatgttttctatattttgacgttatttggttgtaatcatatttaagtttgactaggaaagatgagctcagagagcagcacagatggattgagtaagggtgtgtttggttgagtggagaacggttgtacgaaagaggggcgaactctataaattattgggatgttcttgctcc

SEQ ID NO: 87 - DNA, 1075 bp, Zea mays
cctctcgcatccgcagcttccccagccagctagggtttgcagatgacgaccgcggcgcgccccacctgggcgccggccaagggcggcaacgagcaggggggcacccgcatcttcggcccctcccagaagttctcctcccgcgacctcgccgcgcacacctccctcaagccaagaaaagacggtcaacagacccaagaggagttacagaagaggaatctcagggaggaacttgaggaacgtgagcgcaagcactactcttccaaggataagtcctatgccgaagaaagagaccggcggaaaagctctagccatctactcttagaaggttcaaagagagagacagaggataagatagttccacgagaaatcgatgctgatgactccgatgtggagcctaaaagcgatgacgagagcgatgaagatgatgatgacgacgacactgaagctctaatggcagagcttgagaggattaagaaagaaagagccgaggagaagcttagaaaggagcggcaacaagcagaagaggaggccaagatgaaggaggctgaactgatgcggggaaacccgttgattaatatcaacaatgctggctccttcagtgttaagagaaggtgggacgacgacgtggtattcaagaatcaagcacgaggagagaccaagacaccgaaacggttcatcaacgacaccatcaggagtgatttccaccgtaaatttcttcagaggtacatgaagtgacgcttccgtcgttcacaattcagcctggagcccctcatcgttatcatgtttgtgtatgagcgaaagatcattattgtgttgttgtatgaaacaagagtgtaaacatatgtctactacttaacaaagttatgctgagcaatgcatatcctagttgaatgtgacaatgctatgttttctatattttgacgttatttggttgtaatcatatttaagtttgactaggaaagatgagctcagagagcagcacagatggattgagtaagggtgtgtttggttgagtggagaacggttgtacgaaagaggggcgaactctataaattattgggatgttcttgctcca

SEQ ID NO: 88 - DNA, 2132 bp, Arabidopsis thaliana
catcgggacacatctttaggctcaaggattcaaatgaaaatcagaagtctctagaaaaaccccaaaacactctttcttcactccccctataaattctcatcacaatttctcaaaccatctcatctctgccaacacactctctagaattctctcgtgattatcgatttcactctcttaaatttgatcagaaaatggaagacgatttcgacacgcagaaccagtttccggaagaggagccagaggagatggatatggatctccccgacaatgacgaagctgactctgctccttatctgaaaatcggcgaggaaatggagatcggaaaatcaggattgaagaagaaacttgttaaggaatgtgaaaaatgggacacgcctgagaacggtgacgaagttgaagtgcattacactggaactttgttagatggtaccaagtttgattcgagccgtgacagaggaactcctttcaaatttactcttggccaaggacatgtcattaaaggatgggacttggggatcaagacaatgaagaaaggtgaaaatgctattttcaccattcctcctgagctggcatatggtgaaaccggttcaccgccgactatacctccgaacgctactcttcagtttgatgtggagttgatagcatggaggagtgttaaggatatatgtggtgatggtggtgtgtctaagaaaataattgtggaaggagaaaaatgggagaagccaaaagaccttgatgaagtttacgtcaagtatgaagctcggcttgaggatggcaccattgttggaaagtctgatggtgtagagtttactgtcaaggagggccatttctgtcctgcgctttctaaggctgtcaaaaccatgaaaagaggggagaaggttctcctgactgtgaagccacaatatggatttggggaatttggaagaccagcttctgatggtcttcaagctgcaatcccaccaaatgcaacccttcagattgaccttgagttggtttcttggaagactgtggtggaagtaactgatgacaggaaggttattaagaaaatactcaaggaaggagaaggatatgagcgtcccaatgaaggagcgattgtcaaattgaagttgattggtaaacttcaagatggaacaaccgtgtttgtgaagaaaggtcatgaagaagatgaggagccgttcgagttcaagattgatgaagaacaagtgatagaagggcttgaaaaagctgtgatgggcatgaagaagggtgaggtagcactcatcacaatttcaccggaatatgcttttggttcctctgaatcaaaacaggagctggctgtaataccgccaaactcgactgtatactatgaggtcgagttggtatctttcatcaaggagaaagagtcttgggatatgaacacacaggaaaggatagaagctgcaggcaagaagaaagaagaaggcaatgtgttgttcaaagctggaaaatacgcaagagcttcaaagagatacgagaggggtgtcaaatatatagaatatgactcaactttcgacgaagaggagaaaaagaaatcaaaagatctcaagattgcctgtaacctgaatgatgcagcttgcaagctgaaactgaaagattacaaggaagcagcaaaattgtccacaaaggtgttggagatggatagtaggaacgtgaaggcaatgtataggagagcacatgcctacttggagacggcggatcttgatctggctgagcttgatatcaagaaagctctcgaaatcgatccagacaacaaggaggtgaagatagaatataagaagttgaaggagaaggtgaaagagtataacaagaaagatgctaagttttacagcaacatgttgtcgaaaatgcttgagccacacaaaggaactcagaaggaagcacaagcgatgagtattgacaccaaggcatgagtctttgaatcactttagagagtcgcattgattccaaaaactaaatgtgaaaagtctacaaatttctgtttttactctttgtaatcaatcttggtgtgtgttactgtttcagagttgttataaaacagacttgtaataaacgaggatctactccaagttaatgaccccaatagcttgatatatcatatctagtagttatgttct

SEQ ID NO: 89 - DNA, 2131 bp, Arabidopsis thaliana
tcgggacacatctttaggctcaaggattcaaatgaaaatcagaagtctctagaaaaaccccaaaacactctttcttcactccccctataaattctcatcacaatttctcaaaccatctcatctctgccaacacactctctagaattctctcgtgattatcgatttcactctcttaaatttgatcagaaaatggaagacgatttcgacacgcagaaccagtttccggaagaggagccagaggagatggatatggatctccccgacaatgacgaagctgactctgctccttatctgaaaatcggcgaggaaatggagatcggaaaatcaggattgaagaagaaacttgttaaggaatgtgaaaaatgggacacgcctgagaacggtgacgaagttgaagtgcattacactggaactttgttagatggtaccaagtttgattcgagccgtgacagaggaactcctttcaaatttactcttggccaaggacatgtcattaaaggatgggacttggggatcaagacaatgaagaaaggtgaaaatgctattttcaccattcctcctgagctggcatatggtgaaaccggttcaccgccgactatacctccgaacgctactcttcagtttgatgtggagttgatagcatggaggagtgttaaggatatatgtggtgatggtggtgtgtctaagaaaataattgtggaaggagaaaaatgggagaagccaaaagaccttgatgaagtttacgtcaagtatgaagctcggcttgaggatggcaccattgttggaaagtctgatggtgtagagtttactgtcaaggagggccatttctgtcctgcgctttctaaggctgtcaaaaccatgaaaagaggggagaaggttctcctgactgtgaagccacaatatggatttggggaatttggaagaccagcttctgatggtcttcaagctgcaatcccaccaaatgcaacccttcagattgaccttgagttggtttcttggaagactgtggtggaagtaactgatgacaggaaggttattaagaaaatactcaaggaaggagaaggatatgagcgtcccaatgaaggagcgattgtcaaattgaagttgattggtaaacttcaagatggaacaaccgtgtttgtgaagaaaggtcatgaagaagatgaggagccgttcgagttcaagattgatgaagaacaagtgatagaagggcttgaaaaagctgtgatgggcatgaagaagggtgaggtagcactcatcacaatttcaccggaatatgcttttggttcctctgaatcaaaacaggagctggctgtaataccgccaaactcgactgtatactatgaggtcgagttggtatctttcatcaaggagaaagagtcttgggatatgaacacacaggaaaggatagaagctgcaggcaagaagaaagaagaaggcaatgtgttgttcaaagctggaaaatacgcaagagcttcaaagagatacgagaggggtgtcaaatatatagaatatgactcaactttcgacgaagaggagaaaaagaaatcaaaagatctcaagattgcctgtaacctgaatgatgcagcttgcaagctgaaactgaaagattacaaggaagcagcaaaattgtccacaaaggtgttggagatggatagtaggaacgtgaaggcaatgtataggagagcacatgcctacttggagacggcggatcttgatctggctgagcttgatatcaagaaagctctcgaaatcgatccagacaacaaggaggtgaagatagaatataagaagttgaaggagaaggtgaaagagtataacaagaaagatgctaagttttacagcaacatgttgtcgaaaatgcttgagccacacaaaggaactcagaaggaagcacaagcgatgagtattgacaccaaggcatgagtctttgaatcactttagagagtcgcattgattccaaaaactaaatgtgaaaagtctacaaatttctgtttttactctttgtaatcaatcttggtgtgtgttactgtttcagagttgttataaaacagacttgtaataaacgaggatctactccaagttaatgaccccaatagcttgatatatcatatctagtagttatgttcta

SEQ ID NO: 90 - DNA, 1749 bp, Arabidopsis thaliana
acttgtaaacttgagtattttaattaaatgaaaataaaccataaataaatgaagttctaaacttgagtaataataaaaacagaataaaaaaaaaggtatgtggggaagttttgaaggggcttttgggcttagaaaaggaaagaagtaaaggaagaagcggcgcacgtggcaggcagtcacgagagtcacgagagatcgagagaagtctttgattctcttctctcatcaaatcaaaatatcatctcagagactccgattctctctgtttctcctccacttttcaacccaagtccaccctcaaaattctcagaatgattgctcggatccttgccgccttagccgattccatggagatgccggtggctgccggtggtggatcagtgctcggtaccatcaaaatcgctgtgatgccaattgcaaaggtattcaccatgtgcttcttgggtcttctcatggcctccaagtacgttaacatcttgcctccctctggccgcaaactcttgaacgggttggtcttctcgcttttgcttccctgcttgatcttttcccagctcggacaagccgtcactctccaaaaaatgcttcagtggtggttcattcccgttaacgtcgttcttggcaccatctctggctccataatcggtttcatcgttgcttccatcgttcgtccgccttacccttacttcaagtttacaatcatacaaattggagttggcaacattggcaatgtgcctcttgttttacttgcggctctttgtagggacacttccaacccttttggtgactccgaaaaatgtagcattgatggcactgcttatatctcctttggtcaatgggttggtgccatcatcctctatacatatgtgtaccagatgtttgctcctcctccagaagggtttgatgctgaagaagaaaatcttgctttaaaaacccttccagtagatgctgctccagagcaagtccccttgcttactcagaattttcccaaggacttttcgccgactcaagatcttttgcctgtacagagcaccgaacctaggggaagaggggtttcaaggaaaggcaagattgcacagatctttgttttcctctatgagaagctgaaactgaagcaaattgtccagcctgcaattgttgcttcgatccttgccatgatactcggagcaatacctttcacaaagaagttgatattcacaaatggtgcacctctattcttcttcacagacagctgcatgattcttggggacgcgatgataccgtgtatcttactggcactggggggaaatctcattaacggaccaggaagttcaaaacttggtttcaagacaacagcagctattataattggacggttggtgttagtgccaccagtaggactaggaatcgtgacagtagcagacaaacttgggttccttcctgctgatgataagatgttccgatttgtgttactccttcagcacacaatgcctacatcagtgctctcaggagctgttgccaaccttagaggctgtggaagggaatcagctgctgtgctcttctgggtccacattttcgccatcttctcaatggctggatggatggtactctacattaacatactcttctgaattctcttcttattgacacattcatctgctactatacaatacttctgtgtaaatacagtggcatctcctatgtgcctgaaccaaccaaaattctgattttttttttttcctttcctgtgtaaatgttagtttataactcttt

SEQ ID NO: 91 - DNA, 3684 bp, Arabidopsis thaliana
atgcgtttgcaatgcttttttatttgaaactttgaatggactatgtagctatcagaaccaaaactctcgtattaacaacttacgaatttataaaagaaaacattacaaaaactaagggtcttggtcgattcaccacagatctctacaagaacacttgccattcacaaaatgatgaaaccctgaggaatctctcaaaactatctctctttttaccacaactgaaatatacttgaagaactcgtggcaatcaccacagagcattacgttcttcataacccgaaccggcttgccccgagtattgctcgagagaattccataagtcactgcgagtttcgcgctgtggtgaaacaagaaactcttcttcataaactcatcaacctcctgaagaacatactctgtgtttggttcgtatccaactttcagacattccattatcagtatctccaatcccctgtatatgtctttctcttgcgggtgggatgtgtcacgcgcgtgaaaggaatgtattttgttctcatggattatccagcttttagcaggatgtttccggtaacctctttcccgcatttcctctcttatcatttcagagcgatgccagaatccggaagctgagtagatgttggatttgaggatgtactcagacggggtttctggctttgtagatagtataagctttgctactcgtttcgcaacgcttgtgtttgaatgtattctgcagctatcaagcagagctctcaaaacagagacctcgggctgaaccggcattgagtttattgtgtcttccgcttcttcaagaagaccccaatgaccaagaacacggacgaatgcagtgtaatgttcagtcgttggttcaatgtcatagatagtcttcatggagagaaacagatcacggcagctactaagcttatttgactctgtataccgaaatgcagaaataacaagagtgagggtgattatgtcaggcttgatctctttctcattcatcctcgaccatagagccagtgcctcatcaccatttctttgaaggatgtagcaagaaatcaagctgttccaagaaataacatcatgttctcgcatagtgttgaaaatctttatggcatcatctgagtcacaacatttcgcgtacatgctaatcaaagaatttcccaagcttatatcagaaaagtacccagctttaagagcatagcaatggatctgataacccatttcccgaaaacctaatgtcccgcagaccgcaagaatcaaagtcaacgaaacttcatctaaaaacaacttctgttcacagagagtgcgatggaatagcgatacagccttatcaggtaagccattccgagcgtaaccaccgattatagacgtcgttgctttcgagctatcgagattagaaggccattggtcaaacatctcctcagcatctgccatcctttcacaccttgtgcacatatcaagcaatgcagtctggatacaagggttgaaagcagttccaaacttaatacaaaacccgtgaatctgttcgcttactttcttctctgaaactaaaccacaagcatcaacagcgcttgttaaactaaaatccgtcaactcaacacctctctgcagcatatcagtgaataattttagtgccttcaagccatggccatttctacagaacccagccatgagcgcattatacgtaatagtgtttttttcagttacattcgcgaatatctcaacagcggaatccaccattccaaatgacatgtaagctgtgatcatctccgtgaaagtaacagcatcttgcgccatcatcatctcgtataaactctctacctttttcatatcccaaaatttagaataaaacccaatcagagcgttgttcacactcaactcctgcatcaaccctatcctaattgcacgaccatggagttctctacctctcaataagacactagaatcagtacaagagctcaaaagcgttgaaagcgtaaaactatcaactccaaatccttcgactctattcatctcataaaacaaatcgaaagctttatgagacttgccctctttcactaaactcgaaaccacagtgttccaagacgccacatctctctgaggaatttcatcgaacaacttaagcacatcatcacacgaagacccagaatccttatcatacaaactcatcagcgaattactaacaaacacagaattcaaaaaccctgatttaactatcaatccatgaatctgaatcccaagcgagaatcgggaaactctcacgcaagcagtcaaaatcgctacaaaagtatactcattcggctgaacaagacctgcttttctcatcctgaagaaaaccttaagagcctcaatttcaaggtttaaccttgagaaacccgagataagagctgtgtaagaaaccaccgttggcgaagacagagacacgaagacgagaatagcttcacgagggaaaccaagtttgagataagtagagataagggcatttccaagacgggttttttcttctctgagcttaagaaacgaagcgtgcacagcttttgttacctcgacgtcgtggtattgagcagacaatcgaagcagatagaaaaacccatcaataacagattcaatgtcttccgtttcttctttatcgaacgatgaagaagaagaagatgaggaagaagaacattcatggattgttgctggtgaaagagacagagacgcagagagagcaaagaggcgttctggttttcgatagagggagagagaagaaagaagtttgggacgatgattcggaggaattgaaggtgggatatgaggaaaattgaggaggcagtgatgattaacggtggacatgaatgaatttttgagcttttgggcgcctaaatcgyymtsgakaamcaataaacaaaagtaatcagaagatatctttgtaacatctttgaatttcgctaaaggaaaagagagagatttggtaaaaatgcagtcgatgaaagaaacagcttcgaatattgcagcttctgcaaaatctggcatggacaaaaccaaagctaccttggaggaaaaggcggagaagatgaagacacgagaccctgttcagaaacagatggctacacaggttaaagaagataagatcaatcaagctgagatgcagaagagagaaacgcgtcagcacaacgcggccatgaaagaagcggctggagccggaaccggtttaggtttggggacggccactcactcgaccactggacaagtcggacacggcactgggacacatcagatgtcggctctgcctggtcacggaacgggacaactgaccgaccgcgttgtggagggcacggctgtgaccgacccgattggaaggaacactggaactggtcggacaaccgctcataacactcacgttggtggtggtggtgccaccgggtacggaaccggcgggggatatactggataaacggtgttgttcacttgttctgttatttgctctgtttttgttgaatcgaaatttcgtggttttctgtcttactttcgtgttctgttttttttttttctttttcttgtgcttctgaataattgtaggacttcgatctcatctaggtttttgttgttggatgatagtcttactttatgagtagaatgttcatgcaatgtaacagtagtaaaattatccgttaacaatattgtgcccatgcaacttaacaataacaatacattgct

SEQ ID NO: 92 - DNA, 2853 bp, Arabidopsis thaliana
cgatttaggcgcccaaaagctcaaaaattcattcatgtccaccgttaatcatcactgcctcctcaattttcctcatatcccaccttcaattcctccgaatcatcgtcccaaacttctttcttctctctccctctatcgaaaaccagaacgcctctttgctctctctgcgtctctgtctctttcaccagcaacaatccatgaatgttcttcttcctcatcttcttcttcttcatcgttcgataaagaagaaacggaagacattgaatctgttattgatgggtttttctatctgcttcgattgtctgctcaataccacgacgtcgaggtaacaaaagctgtgcacgcttcgtttcttaagctcagagaagaaaaaacccgtcttggaaatgcccttatctctacttatctcaaacttggtttccctcgtgaagctattctcgtcttcgtgtctctgtcttcgccaacggtggtttcttacacagctcttatctcgggtttctcaaggttaaaccttgaaattgaggctcttaaggttttcttcaggatgagaaaagcaggtcttgttcagccgaatgagtatacttttgtagcgattttgactgcttgcgtgagagtttcccgattctcgcttgggattcagattcatggattgatagttaaatcagggtttttgaattctgtgtttgttagtaattcgctgatgagtttgtatgataaggattctgggtcttcgtgtgatgatgtgcttaagttgttcgatgaaattcctcagagagatgtggcgtcttggaacactgtggtttcgagtttagtgaaagagggcaagtctcataaagctttcgatttgttttatgagatgaatagagtcgaaggatttggagttgatagttttacgctttcaacgcttttgagctcttgtactgattctagtgtcttattgagaggtagagaactccatggtcgtgcaattaggatagggttgatgcaggagttgagtgtgaacaacgctctgattgggttttattctaaattttgggatatgaaaaaggtagagagtttatacgagatgatgatggcgcaagatgctgttactttcacggagatgatcacagcttacatgtcatttggaatggtggattccgctgttgagatattcgcgaatgtaactgaaaaaaacactattacgtataatgcgctcatggctgggttctgtagaaatggccatggcttgaaggcactaaaattattcactgatatgctgcagagaggtgttgagttgacggattttagtttaacaagcgctgttgatgcttgtggtttagtttcagagaagaaagtaagcgaacagattcacgggttttgtattaagtttggaactgctttcaacccttgtatccagactgcattgcttgatatgtgcacaaggtgtgaaaggatggcagatgctgaggagatgtttgaccaatggccttctaatctcgatagctcgaaagcaacgacgtctataatcggtggttacgctcggaatggcttacctgataaggctgtatcgctattccatcgcactctctgtgaacagaagttgtttttagatgaagtttcgttgactttgattcttgcggtctgcgggacattaggttttcgggaaatgggttatcagatccattgctatgctcttaaagctgggtacttttctgatataagcttgggaaattctttgattagcatgtacgcgaaatgttgtgactcagatgatgccataaagattttcaacactatgcgagaacatgatgttatttcttggaacagcttgatttcttgctacatccttcaaagaaatggtgatgaggcactggctctatggtcgaggatgaatgagaaagagatcaagcctgacataatcaccctcactcttgttatttctgcatttcggtatacagagtcaaataagcttagtagctgccgtgatctgtttctctccatgaagactatctatgacattgaaccaacgactgaacattacactgcattcgtccgtgttcttggtcattggggtcttcttgaagaagcggaagacacaataaactcaatgccggttcagcccgaggtctctgttttgagagctctgcttgatagctgcagaatacattcaaacacaagcgttgcgaaacgagtagcaaagcttatactatctacaaagccagaaaccccgtctgagtacatcctcaaatccaacatctactcagcttccggattctggcatcgctctgaaatgataagagaggaaatgcgggaaagaggttaccggaaacatcctgctaaaagctggataatccatgagaacaaaatacattcctttcacgcgcgtgacacatcccacccgcaagagaaagacatatacaggggattggagatactgataatggaatgtctgaaagttggatacgaaccaaacacagagtatgttcttcaggaggttgatgagtttatgaagaagagtttcttgtttcaccacagcgcgaaactcgcagtgacttatggaattctctcgagcaatactcggggcaagccggttcgggttatgaagaacgtaatgctctgtggtgattgccacgagttcttcaagtatatttcagttgtggtaaaaagagagatagttttgagagattcctcagggtttcatcattttgtgaatggcaagtgttcttgtagagatctgtggtgaatcgaccaagacccttagtttttgtaatgttttcttttataaattcgtaagttgttaatacgagagttttggttctgatagctacatagtccattcaaagtttcaaataaaaaagcattgcaaacgca

SEQ ID NO: 93 - DNA, 1921 bp, Solanum lycopersicum
ctcgtgcccatttctaccctatatatagaggagcacttgcagttaattctccgttgtctactccggcgatagtttaccggcggcgagtgaaagttgtctctctcactatatctactgactaatcatggctaggaagatgctaattgatggagagttgagcaaacctggtgaagaagaagcgcactatgactttgatttattcgtaataggtgctggaagtggtggggttcgagctagtcggttttcagcccaatatggagctaaggttgcaatctgtgagcttccgtttgatcccatcggctctgaagttagtgggggagttggtggaacgtgtgttcttcgtggttgcgttcctaaaaagattttggtttatggagcagcctatgggccagaactggaggatgcaaagaattatggatgggaagtgaatgagaatgtcaatttcaactggaagaagcttttgcataaaaagaccgaggagattgtacggttaaatgggatctataagaggctactttcaaatgcaggagtaaaactatttgaaggtgagggaagagtggtaggtccaaatgaagttgagttaattcaactggatggcaccaagataagctattcggcgaagcacattctaattgcaactggtagtagggctcatcgtccagacattccaggacaggagctagccataacttcagatgaagccttgagcttggaagagttaccaaagcgtgctgtgatacttggtggagggtacattgctgttgagtttgcttctatatggcgaggaatgggttcaacggtggatctatgtttcagaaaggaactcccattgagaggttttgatgatgaaatgcgagctgtagttgcaagaaatctagaaggcagaggaatcactatgcatccttgcacgacattgactaagcttgaaaaagcagaaggtggcatcaaagtgcacacagaccatggtgaagtgatattggcagatgttgtgctcgttgcaactggtcgtctccctaacacaaaaaggttgaatctggatgctgttggtgtcgagcttgacaacatgaaagcggtgaaggtagatgagtactcacgcaccaatatacccagcatttgggccattggtgatgtcaccaatcgaatgaatctcactcctgttgctttgatggaaggaacctgttttgcgaaaactgttttcggtggaaagcctaccaagcctgactactcacatatcccatgtgctgtgttctgcatcccgcctctctctgttgtggggttcagcgaagaacaggccatagagcaaataaatggagaagtttcagtttacacatcatcattcaatccaatgaagaacaccatatctggacgaacagagaagtcagtaatgaagcttcttgttgatgcccagacagataaagttataggggcatccatgtgcggtccagatgcacctgaaatcatgcagggcattgccgttgcactaaagtgtggagcaaccaaggagcagtttgacagtacagtgggaatacatccttctgccgcagaagagtttgtgaccatgcgttcagagtcgaggcgcatttcttcaaacaaaccaaagacaaacctctgaggaaccaaagatgtgataaaaccatattgccacataaaaaaaagggtgatttcatgaggaaaaaaaaagaacacctacattcagtatttacttcatagtattagctacatggtgcgattttgtttttgtgattttgaatacgtttgtgaggaccaacagagaaatatctgcatgttgaataaacagtagcgcttgggtcttttgataattgtactagcagcaagtttcaagcagtgatttggtgttaatatatccccaatctgagttgagaaaatagtctctctaccaccacgaggtaggggtaagtct

SEQ ID NO: 94 - DNA, 724 bp, Arabidopsis thaliana
acataagaacatcgtaatcccatccgtttatatatatattccaagttaaacttcatatcatacacacaaacctaaaacaccgaaacaaaaacaaagagatttaaacaagaagagttattatggcgagcttgctagataaagccaaggacttcgtggcggataaactcaccgcgatccctaaaccggagggttcagttacggacgttgacctcaaagacgtgaaccgtgactcagttgagtacttggccaaagtctctgtcaccaatccttacagtcattcgattccgatctgtgagatcagtttcactttccacagcgccggcagggagattggaaaggggaagataccggacccgggttctctgaaagctaaggacatgacggctcttgatattcccgtggtggtgccgtatagtatactgtttaacctggctcgagacgttggtgtggactgggacattgactacgagctccaaatcggtctaaccatcgaccttcctgttgtaggggaatttactatccctatctctagtaagggagaaatcaaacttcctacttttaaagatttcttctgatcgacaaaacctatatataagaccacacatcgttatgatggtgaatggtgatgatcgtaatgtaataagttgggtttgctataactaataaaatgttattttgccatatcataagtttggacagatcagttcttttgggaagttgcata

SEQ ID NO: 95 - DNA, 683 bp, Arabidopsis thaliana
acttcataagaacatcgtaatcccatccgtttatatatatattccaagttaaacttcatatcatacacacaaacctaaaacaccgaaacaaaaacaaagagatttaaacaagaagagttattatggcgagcttgctagataaagccaaggacttcgtggcggataaactcaccgcgatccctaaaccggagggttcagttacggacgttgacctcaaagacgtgaaccgtgactcagttgagtacttggccaaagtctctgtcaccaatccttacagtcattcgattccgatctgtgagatcagtttcactttccacagcgccggcagggagattggaaaggggaagataccggacccgggttctctgaaagctaaggacatgacggctcttgatattcccgtggtggtgccgtatagtatactgtttaacctggctcgagacgttggtgtggactgggacattgactacgagctccaaatcggtctaaccatcgaccttcctgttgtaggggaatttactatccctatctctagtaagggagaaatcaaacttcctacttttaaagatttcttctgatcgacaaaacctatatataagaccacacatcgttatgatggtgaatggtgatgatcgtaatgtaataagttgggtttgctataactaataaaatgttattttgcc

SEQ ID NO: 96 - DNA, 1873 bp, Oryza sativa
gcgtgccaacgtggccgtgtaaaagccgcctcagatgctgccaggacatggcggcgtaggaactccaacgaccacgtatccacaaaccaaagcccccctttaaaatccgacacaagaaacagatccaaccaattcgctcgcttaagccgccggcaaatcaacccaaccccaagggtttttcgtgtggtgttgaggatccatggctaggaagatgctcaaggacgaggaggtggaggtggccgtcaccgacggcgggagctacgactacgacctgttcgtgatcggcgccgggagcggcggcgtccggggctctcgcacctccgcgtccttcggggctaaggttgcgatttgcgagctcccgttccatcccatcagctcggattggcaaggagggcatggtgggacgtgtgtgatacgtggttgtgtgcctaaaaagatactggtgtatggttcatctttccgcggagaatttgaggatgcaaagaattttgggtgggaaatcaatggggacattaacttcaactggaaaaggctgctggaaaataagactcaagaaattgttagactaaatggagtataccagaggattcttggcaattctggtgtgacaatgattgaaggggcaggcagtttggttgatgctcatacagttgaagtcacaaagccagatggttcaaagcaaagatatacagcaaagcacatattgatagcaactggtagccgagctcaacgtgtcaacattcctgggaaggagttagctattacttcagatgaggccttaagtttggaggagctaccaaaacgtgctgtaatccttggtggcggatatattgctgttgaatttgcttctatatggaaagggatgggtgcgcacgtagacttgttttatcgaaaagagcttcctctaagaggtttcgatgatgagatgaggacggttgttgcaagtaaccttgagggaaggggaatcagattacatccagggacaaatctatctgagttgagtaaaacagccgatggcataaaagttgtcactgacaaaggagaggagatcattgcagatgttgttctgtttgctacaggtcgcacaccaaactcccagaggttgaacttggaagctgctggtgttgaagttgataatattggagctataaaggttgatgattattctcgtacatcagtcccaaatatatgggctgtgggtgatgtaacgaaccggataaatttaacacctgttgcactgatggaggctacctgcttttctaaaactgtgtttggtggccagccaactaaacctgattacagagatgtaccttgtgctgttttctccatcccaccactatcagtagtgggcttgagtgaacagcaggctttggaggaagccaagagcgatgttcttgtttacacttccagcttcaacccaatgaagaacagcatatccaaacggcaggagaagaccgtcatgaaactggtggttgattcagagactgataaagtacttggtgcatcaatgtgtggaccagatgcaccagagattatccagggtatggctgtagcgctgaagtgtggagccaccaaggcgacctttgacagcactgttggtattcacccgtctgctgctgaagagtttgtgacaatgcggaccttgaccaggcgcgtgagcccatcatccaagccaaagacaaacttgtaggcaagatgagtaattttggataaagaaacatatatacccgttttgatttatattttgtggcaaagtgtactctggtttgcatctggtaatttcacgttagggattctacctggaacggtaaaaaggagacaatgtatacttgattgaaataaggtttctgcatatcagcctgtacagagagta

SEQ ID NO: 97 - DNA, 1873 bp, Oryza sativa; identical to SEQ ID NO: 96

SEQ ID NO: 98 - DNA, 1281 bp, Saccharum officinarum
cgacgaccaaaggaaggggaaagaggatatcaacaacagcacctcgagctcgaggcgagggagtagagcaaattgaagcaggtttcgtgttgattcggaggctctcgcttctgtttccggtggagatttgaggcctgcggcgacgatggcacctgcgaaatccggggagaaggcgaccagcttcgccatggcctgcagcctgctcagccgctacgtccggcagaacggcaccgcctccggcgatctcggcctcgccatcagagctgaagccgatgcaaagaggacgtcggcagacacggaaaagggggagacgatgaaggagaccatggatctcttcccccagaacgctgggttcggctcggaagccgccatgaaggaagcccctgatgccagggagccagagaagcggcagctgactatcttctatggcgggaaggtccttgtgttcgatgatttccctgctgagaaagcaaaagacctgatgcaaatggccagcaagggttcatctgtagctcagaaccctggcttgctgccttcccccacagttgcaaccgctactgacagcaccaagatcgcagcagtgccagccgcaccaattgccgtggtcaacacccagaagagtgcagcagatataccccaggctcccaaggcatctcttcgccggttccttgagaagagaaaggatcgccttactgcgaaagcaccataccaaggttccccttcagatgctacacctgtgaagaaggagatggcagagggtcagccatggctcgggctgggacctcagatcgccaatcctgatctgagcctgtgcaaggaggggagccaatgatcgacagtccagcatcgccatcttcaaaactgcgatactcctgtaccagagtaaaggatcatagagagactcaacagtcatgtgccaaagtgttctgttttgggcctatcattccgtgtttttcgcgtggatacataggttgtacgaatgtaaaggacgtagctaatgatggacttgagtaaggattaccggtgctgggccaggttgggctgatcatacctgtggtggcctgacccaaatggccatgttagatgaaactgtaatgtagttgctagaacaagctcatattttgggatgttctgtgttgtttggctttggcactggtgtgtcacaaagctatttgttgtcacagatgcatcccgtatgattgttttatttttatttttgtgttattgtggtttcctctgttgggcttatatatgaaatattaagttcacaaattcaaccga

SEQ ID NO: 99 - DNA, 1281 bp, Saccharum officinarum; identical to SEQ ID NO: 98

SEQ ID NO: 100 - DNA, 907 bp, Zea mays
ttgggtacctcgaggccggccgggatgatccttcaggcagttaaagggatatgatgagtggtaaaagctcggtttttttttccgagaggggtgcctgccccaaataagcctgttacgacaacatggcgctcacaatttgtaccatctgatcccgaggaaatgaggctgcaaccaaaatattagctcggcaacttgtcaggctgaggcaacaaatcctcaatttgcaaggcacacgggcacagattcgtggagtagctactcacacacaggcaatgtatgctggcacttcaatctctgctggaatgaaaggtgcaagcaaagctatgtcagcaatgaacaagcaaatggaaccggcgaaacagataaaggtcatgaaagaattccagaaacaatcaacacagttggacatgacgcttgagatgatgtctgatgctattgatgaaacacttgacaaagatgaggcggaggaggaaacagaagagcttacaaaccaggtccttgacgagattggcgtcgatgtggcttctcagctctcttcggctcctaaagggcgcatcggagctactaacaagaaagtcgataatggtcaagcacgtcctgcaaggaacgtggcggctcctgctctagaaccctcctctgctgaagttgaggatctggagaggcgactggcatctctgcgccgtacctgagtctgagctgttgaagaaagaacttgtttgtaatatgtgtagggaaaacagcgagctgcacatgatacggttgaacctacttaatgttttatttaatttggaagttgactgcacagtcaccctagtcgctagtcccattagccgacggaactaggcgaagccagggctgatcaacmatacgaagggtgtttcgtatgttttttatactaattttcagc

SEQ ID NO: 101 - DNA, 807 bp, Hordeum vulgare
  misc_feature (7)..(10): n is a, c, g, or t
  misc_feature (66)..(66): n is a, c, g, or t
tcgcccnnnngggccctctatagactggttactccactttgtggcggcttttatcacactagtggntcccccggctgctttgagtcggcacgagcgatccgcactagtcactgcaagaaccaccacaggtgagtgatccatcggcggagcaagggaagaagcacacagggagagatggcaatgaggccgctcgtcgtcctggccctggcggtggcgctggccggcgtggcgctgggagagggggccggcgagtgcgggaggtcgtcccccgaccggatggccctgcgcatggccccgtgcatctcggcggcggacgagccggactcggcgccctccagcagctgctgctcggcggtgcacaccatcggcaagagccccagctgcctgtgcgccgtcatgctgtccggcaccgccaagatggccgggatcaagcccgaggtcgccatcaccatccccaagcgctgcaacatggccgaccgccccgtcggctacaagtgcggagattacacgctgccttgagtggcccagctctggtgccgatgaagatgaatgctgtggaaggcgtacgtcgtcgtgtgggaataagcgagtggtgcatgtaccacttaagttggggcactagtgactccatggaggtgccacatcatgtgatgtgtgcttgtggaaatatgtttctgtaagcatgtaaaatgtttcgtctctgtgttaacgtgaacaaacgtctccgtgtgatctctattgtcgtacggaaggctttggcctggctcactaaaaccagtgcatcagcgtgaaaaagattgcaaacta

SEQ ID NO: 102 - DNA, 807 bp, Hordeum vulgare; identical to SEQ ID NO: 101
  misc_feature (7)..(10): n is a, c, g, or t
  misc_feature (66)..(66): n is a, c, g, or t

SEQ ID NO: 103 - DNA, 590 bp, Saccharum officinarum
ctcatgttgctgcagaaaaaaggccaattcacatgggacgaggtggtggtgatggttcttcacatggtccggtgcagagaattcactaaatacgaccccaaaatcaatcttgttgtctgtacgcgctgttgtctattcaacatagccttcttcgacctcaataaagagtcggaggttgtgccgcgcccaccaattagcaagatccctgtctctgatctgtggcgcttggaggactcagtcaacgtcatctcgatcaaggttgctgagtccgacgttggttacccaatcaacgtatacggcaccgtgctggcaagggatgagtatgactacagatgtatctatttattcaagcgtggcagggacaatccccaactcatcacatcaccggaggatacgctaactttaacaggcccatatcgagcatttggtgtgacaggtaatatgttctttgaggtccatttgaagattaagagagacggggcaatcgacaaagatttcaacaaagctctgatacaacacaataccagccatcatacatgcgaacctatggctgtttcactagtaaattgtctcagtacagtggtgatggt

SEQ ID NO: 104 - DNA, 590 bp, Saccharum officinarum; identical to SEQ ID NO: 103

SEQ ID NO: 105 - DNA, 2226 bp, Oryza sativa
atggcaaggagtagaagaaggcgtattgttcagagcaatgaggaatatttgtcagaggaacagattgaagaagaaaatacccttccacagcttgccacaccatctgaacaagaaactgtatgtcatgattctggagaaggcaatgaagacattgatgacgattttgatatcaatgatggagaaggtaatgaagacactaatgacgatgttgatattgatgatgaaggcaatgaagatactgatgttgatattaatgttcgagttgaaaatggagcacctgaaacacgtggcaagacaaaactgaaagatgtttggaaccttccgaaagggcttagaattgtggttcaatgcaatgatctcaatcaggcggtaggggaagaagctggaattttgggtaaatttcttggaatgatagctaggaatggtagtctgtgtagcttaggctacacagactggagatatgtaataggaaagagagagaaaaatacaaatgaactaaaagttaaaaaggacatacttaagcaagtaaagatgagattcctttatgctcctcggatggaagagttcatattaaaaaaaattggagaaagatggcggcaatataaagcaaaactaaaagatttgtattttgatgtgaatgagactaaggaagctaattgcaacaatgtcccagaaggtgtgctttctgaccagtggattgctcttgtcaatcattggatgaacgagaaatcgaagagaataagtgagcagaataagaaaaactgccaaaagaagaaggcaattcacacagcagggacaaagagttttgctcgcacaagagaagagatgagacaaaaagatcctgcaaagaagaacccacatagagctgttgtttatgtccacacacacaagcgcaaaagtgacaagaatataaatgggcatgtggataatttgaagagacttatagctgaacaaccagctttagcggatgctagtaaaggaaagactgcttggaaaggagatgcattgaaccaaatactaggagatgacaagcctgggcgtgtgcatggtcttggactagttccaaagcctaaacaagtgcttgatgtgccaacttcccgacgtttgcagaatataaatcttactacagtggaggataactccagtgaagatgtaatggctattagactgcagatggaaaagttagaacgccatgttgagaataatgatgctaaacttttacaattaaaagagaaggcaaccaagttggaaaaggcacaaaagaatcagagagtgtatggtgacaacccctcgcaagaaatttgtatgtttgaggagggaaacattatggatcagcaggacaacagtttgatgaatacacaaagccatgtgcacgatgagaatttgcaaccaccaactaagcattctactgtttacaagaatacacagtctttgggccagaatcacagtgggaagcaaaggaagattacttcctgtgcaaacaagcgcaaaggaaatttggaccagaatgagcttatgcaaccagggaagagtatttctagtgcatacaagaacaataaacctgacaaccaggacaactatatgttgaatgcacacaaagttacaagtacacacaagaacaaagagaaccttacccgcaagcttgttagaccaagcctaaacaagtatagtactgcttctaagaaacggcaatgcaacacaatggactttttaactgacaattcaacagtgaaagtgtatggtgacggtcccttgcaagaaatttgtcatgttgagcaggaaaacattgtgatgaattcacaaagccatgttcaagatgaggataagacaccaccaaccaagcatgctactgcacacaagaacaaacgaacctttggcctaaatgaccatgggaaacagatggagattatttgtgccaagaaacaacagtgcagcaaaatggactttatcactgacaattcaatggaggttggaactaaagtattcttaaaaagttggaaaaatcggaatacaaacatggctcttgccactattgtaagttgtgatccaacacgcagagttggaggtgttgagctaggaaatgaatttttaatggttcatgtcgatcttgcattggcaaaatccgaagatttgattaggctatacaaaggctacaaaattgttggtcatgttgtaggacttgaaattgcgtggtctgcaattttcgttgacaagataaatgggtga

SEQ ID NO: 106 - DNA, 2226 bp, Oryza sativa; identical to SEQ ID NO: 105

SEQ ID NO: 107 - DNA, 1977 bp, Vitis vinifera
tttttgcgaagtagttctacrctcttctcttcattctctcccttcagaccttccaaatctgtcttttaagtttacacatcttcattccacgttcacaagccaccattttctttcattcagactgagagagaaactctttactctgtttctttcgtttatctgcttcttgattcggagatctttgattgtttacgatctgttctgctccaggcttggaaaccttttcttgccagcattcgaaggataatggcagagtttcagaaccctgatttggaatacgttgttgatgactactacgacatgaccgattttgaagaagactctttttctgagaccgatccacagaggaacagtccctttgaggctttcgactcggacgttgaagacaactttgaaatgaacaagccaaagactgatacctctgctctggaagctagaaatgggaaagatatacagggaattccctgggagaggcttaattttactagagataagtatcgggagacaagattggaacaatacaagaattatgagaacctatcgcgccctcgggaagagcttgaaaaggastgcaagaaaatagagaagggaagcaccttctatgattttcagttcaacacaaggcttgtcaagtcaaccattgtgcatttccagctgaggaatttgttatgggcaacatcgaagcatgatgtataccttatgcagaactactcagtaatgcactggtcctcattgctgaggaggggtaaagaagtactaaacgtggctaraccaattgtttccacactgaagtgcccaggatctttggggcagtcactctcaagagtgcagataagcactatgaccgttaaagagaacttaatggtggcaggtggttttcagggagagcttatttgcaagaatttgagtcagcctggggttgcattttgtgcaaaattaaccacagatgataatgccatcaccaatgcggttgatgtataccataaccccaatggctcgttgagggtcatggctgcaaacaacgacgctgaagttaggatctttgatgctgagaacttcgcttgccttaatcggttcacctacccttggtctgtaaataacacctctgttagcccagatggaaagctgctagctgtccttggtgatagtgcagagtgcttgctagctgatgctcagacagggaaagttgttgcaacccttaaggggcacttggactattcatttgcttcagcttggcacccagatggacgaacattggcgactggaaaccaggacacaacatgtagactctgggacatacggaaccttgccgagtcccaggcggtacttaagggaaggatgggagcaatacgagctgtgaggttctcttcagatggtcgatttatggctatggctgagcctgcagactttgtccatgtctttgacacggagtcaggttatgtgaaggggcaggagattgatctttttggcgagattgctggaatatccttcagtcctgacacagaagctctttttgttgggattgcggatcgcacctacggtagcttattagaattcaacaggaggaggtgtaatcagtatttggattccattatatagtggaatggaaatctgaagttggcggctaaaaattgggaatgaagcataataatttattgggttgaggtggatgtgcataggtagcataggttggaggcttagatttttggcctgtcggcttaaaggttgttgttttccagttttttggataaccgattacattttggctgcccaagtagagaaagctagaggcatttgggaactctttttcttgtaaatgtgatttccttttcgaatcggaaatgtgagataaattttttctggtgtaaagaatgttgatgtgattttagtttgtatgtgggaagtggtcacttgtttagatttcccttgctgctaccccttcaagggcatgaaaaatatttggattattattttcca

SEQ ID NO: 108 - DNA, 1867 bp, Vitis vinifera
tttttgcgaagtagttctacactcttctcttcattctctcccttcagaccttccaaatctgtcttttaagtttacacatcttcattccacgttcacaagccaccattttctttcattcagactgagagagaaactctttactctgtttctttcgtttatctgcttcttgattcggagatctttgattgtttacgatctgttctgctccaggcttggaaaccttttcttgccagcattcgaaggataatggcagagtttcagaaccctgatttggaatacgttgttgatgactactacgacatgaccgattttgaagaagactctttttctgagaccgatccacagaggaacagtccctttgaggctttcgactcggacgttgaagacaactttgaaatgaacaagccaaagactgatacctctgctctggaagctagaaatgggaaagatatacagggaattccctgggagaggcttaattttactagagataagtatcgggagacaagattggaacaatacaagaattatgagaacctatcgcgccctcgggaagagcttgaaaaggactgcaagaaaatagagaagggaagcaccttctatgattttcagttcaacacaaggcttgtcaagtcaaccattgtgcatttccagctgaggaatttgttatgggcaacatcgaagcatgatgtataccttatgcagaactactcagtaatgcactggtcctcattgctgaggaggggtaaagaagtactaaacgtggctaaaccaattgtttccacactgaagtgcccaggatctttggggcagtcactctcaagagtgcagataagcactatgaccgttaaagagaacttaatggtggcaggtggttttcagggagagcttatttgcaagaatttgagtcagcctggggttgcattttgtgcaaaattaaccacagatgataatgccatcaccaatgcggttgatgtataccataaccccaatggctcgttgagggtcatggctgcaaacaacgacgctgaagttaggatctttgatgctgagaacttcgcttgccttaatcggttcacctacccttggtctgtaaataacacctctgttagcccagatggaaagctgctagctgtccttggtgatagtgcagagtgcttgctagctgatgctcagacagggaaagttgttgcaacccttaaggggcacttggactattcatttgcttcagcttggcacccagatggacgaacattggcgactggaaaccaggacacaacatgtagactctgggacatacggaaccttgccgagtcccaggcggtacttaagggaaggatgggagcaatacgagctgtgaggttctcttcagatggtcgatttatggctatggctgagcctgcagactttgtccatgtctttgacacggagtcaggttatgtgaaggggcaggagattgatctttttggcgagattgctggaatatccttcagtcctgacacagaagctctttttgttgggattgcggatcgcacctacggtagcttattagaattcaacaggaggaggtgtaatcagtatttggattccattatatagtggaatggaaatctgaagttggcggctaaaaattgggaatgaagcataataatttattgggttgaggtggatgtgcataggtagcataggttggaggcttagatttttggcctgtcggcttaaaggttgttgttttccagttttttggataaccgattacattttggctgcccaagtagagaaagctagaggcatttgggaactctttttcttgtaaatgtgatttccttttcgaatcggaaatgtgagataaattttttctggtgta

SEQ ID NO: 109 - DNA, 2277 bp, Vitis vinifera
aatgaatagtgagcataacactaatggggtttctgatgacctcaaagctccactgcttccagtccaggcgaccacaatggagacctcaaatggggcgtctctcatgtccattttcacacccaagagcttcttcatcctcttggggcctctgctctgcaccctcatctgcctttttgtgaagcttgatggccctgtgaccagcaggaacatgttggctgttcttgcttggatgtttgcttggtggatcactgaagctgtgcctatgcccatcacctccatgtctcctctcttcctctttcccctctttggaatcgcttccgcagatgatgttgctcactcctacatggatgatgtgatttcccttgttcttggaagcttcatacttgctcttgctgttgagcattacaacatccatagaagattggccctcaatattaccttgatcttttgtggagatccactgaatcccccattgcttctccttggcatctgtgccaccacagcctttgtgagtatgtggatgcacaatgttgcagcagcactgatgatgatgcccgtagccactggtatcttacagaggctaccatcaggtccaactcgatctccccatgtggataaattttgcagagcagtggtgcttggggtgttatactctgctgcagttgggggaatgagcactctcaccggtactggcgtcaatctcatattggtaggaatgtggaagagctacttcccagaggcagatcccatcagctttaacacatggttcttctttggcttccctttggctttgctggttttctttgccttgtgggctattctctgctgcttgtactgctccaggggtgcaggtcccgctctgtctgcttatttggacaaatccagtctcagaagagagcttcaaatgttgggtccaatggcttttgctgaaaagatggtgttggctgtgttttcgatgctaatagtcttatggatgacaaggagcataacagatgatgttcctggatggggagctctcttcaatggccgtgtaggcgatgggactgccagtgtgatgatggcaaccttattgttcataattccaaacaagaagcaaaagggggagaagctgatggactggaacaaatgcaagaagctgccatggaacatcgtattgctaytaggcgctggctttgccatagctgccggagtccggtcaagtggcctggctgatgtgttgtcaaaggccttgactttcctggaacacgctccctacttggtcattgcgcctgccgtctgtctcataagtagtacggttactgagttcacctcaaacaattccacaacaacactccttgttccccttctcatccaagtagcccaaaccatgcacgtccacccgctccwtctcatggttcctggagccattggagcacagttttcttacttgctgcccactggaactccttcgaatgtggtcgggttcacaacaggacacattgaaatcaaagatatgatcaagacaggagtgcctcttaagattgctggaattgctgcattatcccttctaatgccttcacttggagcttatgtttttgggacaaacgaagaaatgtgacaccattcaaatccctgcaaccagtctgcaaattctctacaaacaaggtgaaatgcataggatcggccgctaccatgacaaggcattggctcttggcatattagtagccttattgtatagtagtaaggaaaggaaaagaaatcgtctctgtcaagaatcatgaaagggaaaaaggcacatgcttttctcctatggcaattgttcatttatctaatgattcttcctatggtggatttgttagccttcatactttgtttctgatcatcaatattaaaagttcatgccattattgataaaataacaactttgaaagcaattttcattttgagtctacaaccacttaagcaaattgttgaaaatcagcaccaaggtgattcctacgtactggttcttagtatggtcaactgtcattcaacaatgggatgataaaattatcaaactagacctccatttgtcggtatttagctcagtttgctggtcatcccttgctgtatccaagatgcagaaaaacatatgcaatggcctccttcctcaatagcaagcgaacagattctaggacactttcaagcaaccaatcagacctcgaaaaattcaggtttaagttgcatatacatgttaattacatatcatctcctttaggcatattactccttgaccagaaactcctctgttcctcttta

SEQ ID NO: 110 - DNA, 2277 bp, Vitis vinifera
aatgaatagtgagcataacacgaatggggtttctgatgacctcaaagctccactgcttccagtccaggcgaccacaatggagacctcaaatggggcgtctctcatgtccattttcacacccaagagcttcttcatcctcttggggcctctgctctgcaccctcatctgcctttttgtgaagcttgatggccctgtgaccagcaggaacatgttggctgttcttgcttggatgtttgcttggtggatcactgaagctgtgcctatgcccatcacctccatgtctcctctcttcctctttcccctctttggaatcgcttccgcagatgatgttgctcactcctacatggatgatgtgatttcccttgttcttggaagcttcatacttgctcttgctgttgagcattacaacatccatagaagattggccctcaatattaccttgatcttttgtggagatccactgaatcccccattgcttctccttggcatctgtgccaccacagcctttgtgagtatgtggatgcacaatgttgcagcagcactgatgatgatgcccgtagccactggtatcttacagaggctaccatcaggtccaactcgatctccccatgtggataaattctgcagagcagtggtgcttggggtgttatactctgctgcagttgggggaatgagcactctcaccggtactggcgtcaatctcatattggtaggaatgtggaagagctacttcccagaggcagaccccatcagctttaatacatggttcttctttggcttccctttggctttgctggttttctttgccttgtgggctattctctgctgcttgtactgctccaggggtgcaggtcctgctctgtctgcttatttggacaaatccagtctcagaagagagcttcaaatgttgggtccaatggcttttgctgaaaagatggtgttggctgtgttttcgatgctaatagtcttatggatgacaaggagcataacagatgatgttcctggatggggagctctcttcaatggccgtgtaggcgatgggactgccagtgtgatgatggcaaccttattgttcataattccaaacaagaagcaaaagggggagaagctgatggactggaacaaatgcaagaagctgccatggaacatcgtattgctactaggcgctggctttgccatagctgccggagtccggtcaagtggcctggctgatgtgttgtcaaaggccttgactttcctggaacacgctccctacttggtcattgcgcctgccgtctgtctcataagtagtacggttactgagttcacctcaaacaattccacaacaacactccttgttccccttctcatccaagtagcccaaaccatgcacgtccacccgctccttctcatggttcctggagccattggagcacagttttcttacttgctgcccactggaactccttcgaatgtggtcgggttcacaacaggacacattgaaatcaaagatatgatcaagacaggagtgcctcttaagattgctggaattgctgcattatcccttctaatgccttcacttggagcttatgtttttgggacaaacgaagaaatgtgacaccattcaaatccctgcaaccagtctgcaaattctctacaaacaaggtgaaatgcataggatcggccgctaccatgacaaggcattggctcttggcatattagtagccttattgtatagtagtaaggaaaggaaaagaaatcgtctctgtcaagaatcatgaaagggaaaaaggcacatgcttttctcctatggcaattgttcatttatctaatgattcttcccatggtggatttgttagccttcatactttgtttctgatcatcaatattaaaagttcatgccattattgataaaataacaactttgaaagcaattttcattttgagtctacatccacttaagcaaattgttgaaaatcagcaccaaggtgagccctacgtactggttcttcgtatggtcaactgtcattcaacaatgggatgataaaattatcaaactagacctccatttgtcggtatttagctcagtttgctggtcatctcttgctgtatccaagatgcagagaaacatatgcaatggcctccttcctcaatagcaagcgaacagattctaggacactttcaagtaaccaatcagacctcgaaaaattcaggtttaagttgcatatacatgttaattacatatcatctcctttaggcatattactccttgaccagaaactcctctgttcctcttta

SEQ ID NO: 111 - DNA, 933 bp, Saccharum officinarum
ctgggttcgagttgccacatgtactaccaccacccaaccaatggcgccgcggctgctggcgtgcttcgggcgcaggggcggcggcgcgacggcgtcggcgccggacgacgagggccagcagcaggaggcggcggccccggggcctgtgctggtggagctgttcgcgtcgcaggggtgcggggcgtcgccagaggcggacgccgtggcggcgcggctggcgcaggactccggggacgatggcgccgccgtggtggtgctggcgttccacgtcgactactgggactaccgcgggtggaaggaccccttcgcgtccagcgcctggaccgtgcgccagaaggcctacgtggaggcgctccgcctcgacacgctcttcacgccgcaggtcgtcctgcagggccgcgcgcactgcgtcggcaccgagcaggacgcgctcgcgcaggccgtmcgcgacgcgccgtgctaccccgcgcccgccatcaaggtcacgttccagcggccgaacccggcgacgctgcaggcgtccttcacgggcacgctgcgcagccgcgtggagggccccggcggcgcgagcgtgcttgtggcgctgtacaaragcgggctggtgaccgactgcgggcgcggcagacaaggcaagtcctkstgaagaccacgtgtgcgggcctgagaaggggccgcctgcggagggcgcctcgccaaaaraccgtgtccggcacctccagttcccgctctgggacggcttccgcgccaccaagtgcggcctcgtcctttycgtcaaaacgccscsctkcagtgctcggcgtccagcacttcgaccttccccacaacgttttaatttgttgaccggcggtgggtccctaaacaaatacatatccaccaaacatatattaaaccaatcctcattgccacacatcatcatctatcctactacttact

SEQ ID NO: 112 - DNA, 933 bp, Saccharum officinarum; identical to SEQ ID NO: 111

SEQ ID NO: 113 - DNA, 1409 bp, Solanum lycopersicum
aaaatttcaaaaaaaaatctatatttttcttctctctctacattttgcttacttgtgagaaggaaaaaaaatgggtgttcaggaaatggatcctcttacacagctaagcttaccacccgggttccggttttacccgactgatgaagaacttttagttcaatatttatgccgtaaagttgctggtcatgatttttctctgcaaattattgctgaaattgatttgtacaaattcgatccatgggttcttccaagtaaggcgattttcggagaaaaagaatggtatttcttcagtccaagagatcggaagtatccgaatggatctagaccaaacagagtagctgggtctggttattggaaagcaactggaactgataaagttattactacagacggtagaaaagtcggaatcaaaaaggctttagtgttttacattggtaaagcacctaaaggaactaaaacaaattggattatgcacgaatacaggctcagtgaacctacaacgaaaactggaagttcaaggctcgacgattgggttctatgtaggatttacaagaagaattcaggtggacaaaaatcgagttgctctgatttacagaacaaggatataagtcatgcttcatcatcgtcatcatcatctcagtttgatgatatgctggaatctctaccggcaattgaagatcgttatttctcattgccgagggtgaattctataaggaattttcaacaaaatgacaagatcaatcttcaacaattgagctctgggaacttcgattgggctgctatggcgggattaaactcattcccggaaatacgtaccggaaatcaagttccaacgccgggaaatcaaactccggtgctgataaacaccaatcagtatcacaatcacaacgacaatttgaataatttcaacgaattttttgacaattcaaaggcgttaaattttcacggtgaagttaattttgaaggaggagttgatcaagaagtagaaagcagtgttagagctcaacgacttaacagcgttaacccgggtttcttccaagagaactcaaccgggttttcaagttcttatacaaacttggtacccgaactatttgggattcggtacccgacccaaacagtaaatatgggttttactgggtaaatagtggaagggtaaaatgagaatgctcataaattaacttgaagacaaatttggaaaaattgtcatggttattgaggttgaaaggacattttattttttggttggggattaaaatatcgcaaaaagtagattgacaagattttgttcatgcaattatgcacatatacaatgtattttgttggactaaaatttatagctttggtaatgtacttattataggaatgcatattggaggattttagcttattatattttgaaaattttgatc

SEQ ID NO: 114 - DNA, 1409 bp, Solanum lycopersicum
aaaatttcaaaaaaaaatctatatttttcttctctctctacattttgcttacttgtgagaaggaaaaaaaatgggtgttcaggaaatggatcctcttacacagctaagcttaccacccgggttccggttttacccgactgatgaagaacttttagttcaatatttatgccgtaaagttgctggtcatgatttttctctgcaaattattgctgaaattgatttgtacaaattcgatccatgggttcttccaagtaaggcgattttcggagaaaaagaatggtatttcttcagtccaagagatcggaagtatccgaatggatctagaccaaacagagtagctgggtctggttattggaaagcaactggaactgataaagttattactacagacggtagaaaagtcggaatcaaaaaggctttagtgttttacattggtaaagcacctaaaggaactaaaacaaattggattatgcacgaatacaggctcagtgaacctacaacgaaaactggaagttcaaggctcgacgattgggttctatgtaggatttacaagaagaattcaggtggacaaaaatcgagttgctctgatttacagaacaaggatataagtcatgcttcatcatcgtcatcrtcatctcagtttgatgatatgctggaatctctaccggcaattgaagatcgttatttctcattgccgagggtgaattctataaggaattttcaacaaaatgacaagatcaatcttcaacaattgagctctgggaacttcgattgggctgctatggcgggattaaactcattcccggaawtacgtaccggaaatcaagttccaacgccgggaaatcaaactccggtgctgataaacaccaatcagtatcacaatcacaacgacaatttgaataatttcaacgaatttttygmcaattcaamggsgttaaattttcasggkgaagttaakkytgaaggaggagttgatcaagaagtagaaagcagtgktagagctcaasgacttaacagcgttaacccgggtttcttscaagagaactcaaccgggttttcaagktcttatacaaactyggtacccgamccatttgggattcggtacccgacccaaacagtaaatatgggttttactgggtaaatagtggaagggtaaaatgtgaatgctcataaattaacttgaagacaaatttggaaaarttgkcatggttattgaggttgaaaggrcattttattytttggttggggattaaaatakcgcaaaaagtagattgacaagattttgttcatgcaattatgcacatatacaatgtattttgttggactaaaatttatagctttggtaatgtacttattataggaatgcatattggaggattttagcttattatattttgaaaattttgatc

SEQ ID NO: 115 - DNA, 758 bp, Brassica napus
acacacactttctttacacagcaacatacactttcagaaaaagctttatataattatcatttcatatttcacacctttgaagaaaagaaaaatggcgtctaaccaacaaagctacaaagctggtgaaaccagaggcaagactcaggagaagacaggacaagcwatgggagcaatgagggacaaggctgaggaaggcaagaacaagacttcccaagcggcccaaacagcccaacaaaaggcccatgagacggcacagtctgcaaaagacaagacatctcaaactgcccaaacgacccaatcagcaaaagacaagacatcccaagctgctcagacgacccaagacaaagcccgtgagacaaaggacaagacggggagctacatgtccgaggcaggagaagccataaagaacaaggctcaagacgctgctcagtacacaaaggagacggctaaaggcgcggctcagtacacgaaagagactgctgaagccgatagagacaagaccggtgggttcttaagccagactggtgagcatgtgaagcagatagctatgggtgcagctgatgccgtgaagcacacttttgggatggctaccgaggaagatgacagggaaaattttccaggcacaactactggtactactaggaccactgatacgactcatcagacttatcaggggaagtgaggataacaagagaactatgtctgtgtcttccttttgtttctgtaataccgcctatttggtcttttgagtttctgtt

SEQ ID NO: 116 - DNA, 1141 bp, Solanum lycopersicum
aaataactgaaagtgttaaaaagagaaacagagcaaaaacttacaatttctggggtgaagaaaatggctacactgagaattccagatgttgttccttctccagatgaagactctgaaactcttgtgaaatccttcaaaggactgggaactaatgagaagtcagtgatatcggtgttgggacacagaaatgcaagccagaggaagaagatcagagaaacctatcagcaactttacaacaagtcccttatagatgacattaattctgaattgtctggtgatttcaggaaagcagtcatcctatggacatatgagccttctgaaagagatgcacggctagcaaatgaagccttaaagtcgagaaagaaaaccatcacccagttgcaagtgatagtagagatagcttgtgcatcatctcctgatcatctggtcgcggtgagacaagcatattgtggccttttcaaccgttcacttgaagaagatatcacagcaaatgtcccaatgcctatacaaaagattcttattggtctagtcaggtcctatcgatatgatagagaattggtggatcctagtactgcaaatgaagaagctgctatccttcgtgaagccatacggacaaaacagttggatcatgacaattttcttttcatactcagcacaaggaatggttatcagcttagagcaacttttgagtgctacaagcaaaattatggattctccattgaccaggacattaagagctgtggaaaaggtctgttggaatctatactgaaggtggttatctggtgtattgaatcgccagagaaacattttgctgaggttgtcagagcctcgattcttggatttggaactgatgaggattctctaacgagagccattgtaactcgagctgaagttgatatgatgaaagtaaggggagagtatatcatcgcgaacaaaactagtcttgatcatgcagttattgacgacacatcaggtgattacaggaaattcctcatgacactgcttggtgctaaagtgtagacctgatcattatattgttgtgtttcaatactatgctactactttgtatgatttattcgagaatgcattattggggtggttttgcagtgaaatatttaataattggagagtgaatttgtat

SEQ ID NO: 117 - DNA, 1141 bp, Solanum lycopersicum
aaataactgaaagtgttaaaaagagaaacagagcaaaaacttacaatttctggggtgaagaaaatggctacactgagaattccagatgttgttccttctccagatgaagactctgaaactcttgtgaaatccttcaaaggactgggaactaatgagaagtcagtgatatcggtgttgggacacagaaatgcaagccagaggaagaagatcagagaaacctatcagcaactttacaacaagtcccttatagatgacattaattctgaattgtctggtgatttcaggaaagcagtcatcctatggacatatgagccttctgaaagagatgcacggctagcaaatgaagccttaaagtcgagaaagaaaaccatcacccagttgcaagtgatagtagagatagcttgtgcatcatctcctgatcatctggtcgcggtgagacaagcatattgtggccttttcaaccgttcacttgaagaagatatcacagcaaatgtcccaatgcctatacaaaagattcttattggtctagtcaggtcctatcgatatgatagagaattggtggatcctagtactgcaaatgaagaagctgctatccttcgtgaagccatacggacaaaacagttggatcatgacaattttcttttcatactcagcacaaggaatggttatcagcttagagcaacttttgagtgctacaagcaaaattatggattctccattgaccaggacattaagagctgtggaaaaggtctgttggaatctatcctgaaggtggttatctggtgtatcgaatcgccagagaaacattttgctgaggttgtcagagcctcgattgtcggatttggaactgatgaggattctctaacgagagccattgtaactcgagctgaagttgatatgatgaaagtaaggggagagtatatcatcgcgaacaaaactagtcttgatcatgcagttattgacgacacatcaggtgattacaggaaattcctcatgacactgcttggtgctaaagtgtagacctgatcattatattgttgtgtttcaatactatgctactactttgtatgatttattcgagaatgcattattggggtggttttgcagtgaaatatttaataattggagagtgaatttgtat

SEQ ID NO: 118 - DNA, 964 bp, Hordeum vulgare
cggggactcgtcgtgcggtgcggtgcgttgtcccccccggtcccgtttccttcgtcggcctgcgctgcgcaaccgccggagatctcgtccaccgtcccgctcctccgctcccccggcgaatccgctcggcttccccccaatggagacctgcccttcggtgaagaacattctgctgctggactccgaggggaagcgcgtcgccgtcaagtactacacggatgattggccggtgctctcggcgaagctggccttcgagaagtcggtctttgtcaagacccagaaagcaagttctggcgcggaggctgagattgtaatgtttgatggtcacattgttgtgtataagttcgtccaagacctccatttttttgtttctggaggagatgaggagaatgaacttattttagcatcagttcttcagggattcgctgatgccattgacattattcttagaaataatgttgacaaaagaacagctcttgaaaatctggatctaatcctattatgccttgatgaaattgttgatggagggattgtcctagaaacagaaggaagtgtgatagctgaaaaggtactagctcatggagcagagggtgccacgtcaatcgccgagcagactatagttcaggccctaacaacagcaagagagcactttgccaaatctctgctaatgtgacgtgttatgatctcggagatgaagatggcattaatcaatgtgttcatttcataagcaaaggaaaaggaaggaggggaaatgtccggatctgtgggtgtaaaattacgcgttttcgttgacgttatatgattgttcagttttacaagtcttcaaaatttgtgtagacaaggttgtgaaatgtgattgtctcaattttacttggttcagttgactttcgtgttgttttactatacttgctgtatcaatacaattcttatggaggttaataagccgtcgcccccttctagcttc

SEQ ID NO: 119 - DNA, 707 bp, Hordeum vulgare
  misc_feature (643)..(643): n is a, c, g, or t
  misc_feature (652)..(652): n is a, c, g, or t
  misc_feature (661)..(661): n is a, c, g, or t
gcctgagcccccgttttaactcctaccccatcaggctggcgctgttccgtccagaacatcctttcccgacgagcagccgcccccaggtctagggttcccctttcttcttctccacgcgaatcagctagatactagcagcagcgtcgatggcggcggcagcgccggcggacgccaaggcagaggccgccaagatggacctcctcgaggacgacgacgagtttgaagagttcgagatcaaccaagaatgggatgacaaggaagatggtaatgaagctgtccagcaatgggaggatgactgggatgacgatgacgtgaacgatgatttctcactgcagctgaggaaagagcttgagggaggcaacacccagaagagttgaactacttccccatccatatcaaagctgtagtacacttttatcttcgatcaggcactgtgtggccattgctctctgaacctgcgatactttcctagcaatatcaagccctgatacttatcctcgtttcagcactgtgtatcagacttcgggccagttcttttgagcagattatgaagaatctcggtctggaaaatctttggcgaaaagaacgcgattgcctctccaaatctgtagaggattctgcagaatcctaggccaaacaaatncttacagtngatgggtgntccagattccagagaatttggcttgtccctcatagaaaacgtggga

SEQ ID NO: 120 - DNA, 707 bp, Hordeum vulgare; identical to SEQ ID NO: 119
  misc_feature (643)..(643): n is a, c, g, or t
  misc_feature (652)..(652): n is a, c, g, or t
  misc_feature (661)..(661): n is a, c, g, or t

SEQ ID NO: 121 - DNA, 1185 bp, Hordeum vulgare
gcggccggctcgtgtctcgtgcctccgacgcaacgcgctctcgtcttgctcccagagctggagcccacccgagccgcgacacccttctcctcctccccgcacacccatggggtcgtcggaggccgacgacgaccagctcctcaagagtttcttggccgaggtcagcgaggccgagcgcgacaacgaagtcctcaggatactcggttgcttcaagttaaacccttttgagcatcttaagttgtcttttgattcttctgtggatgaggtgaagaagcaatataggaagttgtcactgttggtccatcctgacaagtgcaagcatccacaagcacaggaagcttttggagccctggcaaaagcacagcaactcctactcgatccacaggaaagagggtacattctggatcaagttacttctgcaaaagaagaactgagggcaaaaaggaaaaaagagctgaggaaagacagcgcatccaagataaaatcccaagtagatgagggaaagtacgaagagcagtttgaaagatcagacgaatttcagaagcagctaataattaaagttcgtgagattttgacggacaaagaatggcgtcggaggaaaatgcagatgaggatatcagaggaagaaggaagactgaagaaggacgaggaggaaacaaaagaaatgtggaagaggaagagagagcatgaagagaagtgggaggagaccagagaccagcgagtctctagctggagggatttcatgaagacaggaaagaaggcacggaaaggagagctcaaacctccgaggctcaagaccgaagacccgaacaaatcttatgttcagaggccagtaaagcgtggttaaaaggaatcgtattcatctgcactcgaagaccaatctgtcggccattcttgccgcgacctgatccaagccacagcctgtcaagttaatctttcaggctataagcttgggttatgacttgtatgttcccagtgtagtcagtggaacatagcagataattgtgagcaaaatggcaacatatcatctacctagagtggtattggactaatgtacctgtgtagaatgcgttcctgaaaaagaaattttctgttgaaaaagaaacactgaagtggatgttggaatatgatccttgtttcatcagtattcagtggaagtgacgctaatatatactcctatttatc

SEQ ID NO: 122 - DNA, 888 bp, Lotus japonicus
caggattcagtcatcatcgaacttatcttccttcttcgttgatcttgagaaaatgtggaagggtatgaattttcgagaagcagaagcagctgacttgatcaactctgatttcagggacctgagtcttgctgctaccaaactagccaatcatgccgtcaaccttggagttggcttcggctttggagcctcctttttcggattgattgctgccattgctgctatttatttgttggttttggatcgtacaaactggaagacaaacattcttacaggactactcattccatacattttcttcagcttgccttcaatcattttcaatgtcttcaggggagaaattggaaaatggattgctctagttgctattgtattgcgcattttcattcctaaacacttcccagattggctggaattacctgctgctttgattattctgatcgttgtagctcctggtctaattgcaaacacctttagagacaacattgttggggtggtagtgtgccttgtcattgcatgttatttgctgcaagaacacattcgagcatctggtggtttcagaaactccttcactaaagcgaatggcgtatcaaattctattggcataataattctgttagtctatcccatctgggcggctgttgtcataattttttaggcaccagcactttgaacttggttgatatgtgtgaattgaaacaactgtattctgtttaaatttgttggaagttgatgtcttgaaacgcactgtcactgcttcatgtagcacccttgttcttttgtttgcttatgtaaagtatcaaatcagatctcattgaaagagtttgtattgattcagtgttaaaaataaatgtgatgaaggggattgatgtagtatcttccattcttcct

SEQ ID NO: 123 - DNA, 888 bp, Lotus japonicus; identical to SEQ ID NO: 122

SEQ ID NO: 124 - DNA, 2145 bp, Oryza sativa
atatgctaccacacaagcactgaattaaatccagtcatccaagttccctaccctcctaccgtgacagaagaaaggaacagcaatggcgaagaagaactacggtcaagtgtacaacatcctcgggtggggcgacccctacttcaccgtgaactcccatggccacctcgccgtcaagccccatggccgcgacaccatgtccggccaggacatcgacgtccactccgtcatccacagagctctcgccaccaccatcaccaccaacgacggcgacaagaagccccagttcccgatgatcctccgcttccccgacgtgctcaagaaccgcctcgactccctccacgccgccttccatggcgccgtcgacagcaccggctacgcgtccaggtaccagggcgtgttccccatcaaggtgaaccagaacaaggccgtcgtccaggacctcgtcaccttcggccatggctacagctacggcctcgaggctggctccaagccggagctgctcatcgccatgagctgcctcgccaaggccaagcccggagcttacctggtctgcaatggctacaaggacgccgactacgtcgcgctcgcgctctccgcgcgcgccatgggcctcaacgccatcatcgtgctggagatggaggaggagctcgacatcgtcgtcgagcagagcgccaggctcggcgtcgagccggtcatcggcgtccgcgccaagcttctcaccaagattccgggacacttcggctccacggccggcaagcacggcaagttcgggatgctcgccgacaagatctacgaggtggccggcaagctgaagaagatggggaagctgcactggctgaagctgctgcactaccatgtcggctccatgatcccgaccaccgacatcgtgtacaacgcggcggccgaggccgcaggaatctactgcgcgctggtgaaggagcacggcgcgacggggatgaccacgctggactgcggcggcgggctcggcgtcgactacgacgggacgcggtcgggcagctccgacatgtcggtggcgtacgggctcgagcagtacgcgtccagcatcgtgcaggcggtgcggctcacgtgcgacgacaatggcgtcccccacccggtgctctgcaccgagagcggccgcgccatggcgtcgcaccactccatgatcatcctcgaggcgctctcggcgatcccggagccgcaggacgaggaggacacccatcaccggctgctcagcaagatccaggacctctcctccaagcagccaagaactgctcataccgtcaatggcggcggcggcgtggacgccatgcactcgcacgccgtggagctgaagaagcacgggatcgagatgtacaagctggcgaagaagctgtccaagagggtgaccggcgacgccaacggcatctacaactaccacatgaacctctccgtcttctccctcgtccccgacttctggggcatcggccagctcttcccgatgatgccggtgagccggctgaacgagaagccgaccatcaacggcacgctggtcgacatcacctgcgacagcgacggcaaggtagagaagttcatccgcgacgccgtgacgctgccgctgcacccactcgacgacgcggcggcggagcacggcggctactacgtggcggcgctgctgtcgggggcgtaccaggaggccctggcgtgcaagcacaacctgttcagtggccccacgctcgtgcgcgtcgagagcgccggcggcggcggcgcgttcaagatcgtctccgttgagctcggcccgacggcggaggaggtcatcggcacgatgaggtacgacgtgaagaacgacattagcgatgtgatcgagaaggttgcgacggagaatggcgtgtggccgatggttgagccgctgatgaagaaagggctgaccaccatgccctacctcaacgattacaagccccccaaaaccaccttttaagcttgtttagaagtagtctttatcgacatataaataagagtgcctcgaccatgatccatgcctccatggacgagcacacggagcacagtctgtatgactgtatatttgcctgcttcatactagtagtttggtgttgtattctcgaataaataacagggaattgctaaatcacaatcgacagaaaattgcta

SEQ ID NO: 125 - DNA, 2145 bp, Oryza sativa; identical to SEQ ID NO: 124

SEQ ID NO: 126 - DNA, 1561 bp, Hordeum vulgare
cgcgcgcgcgctccacaccatcatccatcctcctcgtcctccccccacccccaccctcctccctcagctccacccaccattcttcccgcgcctagcagcagcccagcccctatagctgcccccctcccggacccctccggcgcgggtctgtctctggccgctttctttctttctttctcgggcgagtcggcggccgctgtctttcctttttcggttcacggggccggcgggcggaggttctgtagcgtccgggatggcggctgctgcggcgatctgcggggaggacgagccggcgccgcgcgatccggccgcggcggccgagtgcgcggcggcgggcggcggggtcgagcggctggatctcggggacgggcgggcggcgctcgtggcggggggcaagaggagcgtctacctcatggagtgcgagccggtctggggctgcgtcgccacgccgggacgcggcggggagatggaggacgcctgcgccgccgtgccccgcttcgccgacgtgcccgtgcgcctgctcgcccggcgccaagacctygacgggctcgggctcgacgccgacgcgctccgcctcccctcccacctcttcgccgtcttcgacggccacggcggctccgargtgtccaactactgccgggagaggctccacgtcgtgctgagcaaggagctgaggaggccccccaaggatctgggggagatgagcgatgtggacatgaaggagcactgggacgacctcttcaccaagtgtttccagacagtggatgacgaggtgtcggggcttgcaagcaggcttgtcgacggtgagccccggttagagccgatcgccgcggagaacgtggggtcgacggcggttgcagtggtggtctgctcctctcatgtagtggtggccaattgtggcgattcacgcatcgtgctctcgcgcgggaaggagcctgttgctctctcaattgatcagaagcctgacaggaaggatgagcgcgcgaggattgaggctgcgggaggcaaggtcatccaatggaatggacaccgagtgtccgggatacttgctatgtcacgatccattggtgaccgatacttgaagccatacatcattccaaaaccagaagttacagttgttcctcgggcaaaagatgatgattgtctcattctggcaagcgacgggctttgggacgtcgtgtcgaatgaagaggcgtgtaaggttgcacgtcggcaaatccagcagtggcacaagaacaacagcgttacaacatcatcgtcagatggaggcgatggatccaccgatcctgccgcgcaggcagctgctgactatctcgtgaggctggcgctgaagaaaggaagccaggataacatcactgtaattgtggtcgacttgaaaccccggaggaaatccaagaataattcctaacatgacttgaattcatcatactagtagtcggtcttctaatgagacttgacccacctttttcgttgggtttcaagaattgtacatgtatatgctagatggattttcaacctagtgggttataatgattaattaatcatatcctcgttttggtta

SEQ ID NO: 127 - DNA, 1561 bp, Hordeum vulgare; identical to SEQ ID NO: 126

SEQ ID NO: 128 - DNA, 2022 bp, Solanum tuberosum
ttcctcagtcccggaattcatggcttcgccggaaaacgacatttatcgtccatttctacaaaacaatgtaacatcattatcaccacaattatccgaaactcacaatttcgaatcaagcaacgagctcgaaactgtgctattggacactgaaatacctctctggagtaaactccgattagcgacatggatcgaaatgaagctcctcttcttccttgctgctccggcggttatggtttacatgattaattacatcatgtctatgtctactcagatattctccggtcacttgggtaatcttgagcttgctgctgcttcacttggaaatactgggattcaagtttttgcttatggtcttatgttgggcatgggaagtgcagtggaaacactatgtggtcaagcatttggggcaaagaaatacgatatgcttggagtttatcttcaaagatcgacagttctgttaactctaacaggaattttactcaccatagtgtacattttctgcaagccaattctaatatttctaggccaaactgagagaattgcagcagcagcagcgttatttgtgtacggtttaatccctcagatatttgcctacgccattaattttccgattcagaaattccttcaagctcagagcattgtagccccgagtgcatacatctccgctgctacattagtgttgcatttggggttgagctgggtggtgatttttaagatcggtctcggattacttggggcgtcattagtgttgagtttgtcatggtggataattgttataggccaatttgtgtacattgtgaagagtgacaagtgtaaacagacatggaaagggttcagttggatggcgtttaccggcttgccggagttcttcaagctatcggcggcctcggcagtgatgctgtgcttggagacttggtactttcagattgtggtgttgcttgctggcttgcttgaaaatcctgaagtggctttggatgctctttctatttgcatgtcaatttctggttgggtcttcatgatatcagttggattcaatgcagcagcaagtgtgagagtgagcaatgaactaggagcaaggcatcccaaatcagcagctttttctgttgtcgtggttacatcgtggtctttcattctctcaatgattgctgcagtcatcgttcttgcattgcgtaatctcatcagttatgccttcactgaaggtgaagtcgtggctgaagctgtctcggatctttgtccattgcttgcgctttccctcatcctcaacggaattcagcccgtcttgtcaggtgtggccgttggctgtggatggcaagccttcgtggcctatgtcaatataggctgctattacattgtcggagttccattgggtgttcttctcggcttttacttcaaacttggcgctaagggaatatggtcaggaatgctgggaggtacagtgatgcaaacaatcattttaatatggatcaccgctcgaactgattggaataaagaggtggaatcagctcagagtaggttgaaaacgtgggatgacaagaaagaatcaattctagaggaatagatgaatttaggatggacaaaaaggaggttcatgctaagggattttcccatgttttctctaacaaatggggtttccacaaagctaataatgcagtaataataccaatttttgaatgaagatgatcaagaatcaagattaattatgaagttgatatagaaattgtagtcaaggtccaaaatatatttcccacccaatgcacccatttaagatgtaacttgccactgattttttgttgtaatgatggcttctttgaacataggaagatatgagtatatgtatgttaaatatctatacaagtggatgaactagtgagggagtttgaagctcaatttcattattgggtaactatagtaaattcctgtaatgagccaaggatggcacatgccaaagtcatgattgaaattgtcgcttgtttgaaatgttttgttatgaaataaaattgtatcgttgctattagttaaata

SEQ ID NO: 129 - DNA, 2022 bp, Solanum tuberosum; identical to SEQ ID NO: 128

SEQ ID NO: 130 - DNA, 2843 bp, Gossypium hirsutum
aggaatggagtggggttatcaacggagcatcgacgtgttaaagtgaatcaggaaaaagacacatgtatttgatgcattaccctttcactttctacgttttgtcttatcagttttataggtgaaaataataatatgattagaaaaatggaatacaattttcctaaatttaattgatctaagcagcccctcttgcgtccttttttaaatcaaattccgtttacattacaactcctttacttccacaacacttccaaatcttctttttctctttactttgaaaaagcttacaactttcttccaaatctttcttcttaaacttctgggtttttctttatacgaccaagcaaacgcctcattgccgtgtcgaaagcacaaaacaaacggaaaaattgagctcccaagaaggattgggaaacttgaccagcgaaaagaggagactttgatgctaagttattgttgattgaaagattcccccatcttgggttattattagagaaaaaaagtttctcctggaaagatgagggaaaattcttggtttttaatttgcatgtgggttttgttagtggggaattgtttggggaggtttgtggtggagaagaacagcttgaaggtgacttcgccggaatcaatcaaaggggtttatgagtgtgcgattgggaattttggggttcctcagtatgggggtaccttggttggcactgttgtttatcctaaagctaatcaaggcgcttgcaagtccttcgatgattttgacatctctttcaaatcaaagcctgggggattacccacttttctccttgttgatcgtggagattgtttcttcaccttgaaggcatggaatgctcagaaagctggagctgctgctattcttgttgctgacagcaaggatgagcccttgattaccatggatacccctgaagaagaaaatgctaatgctgaatacctgcagaacatcaccattccatcagcccttatcagtaaatcactaggggacagcctcaagaaggcccttaacggtggggagatggttaatatgaatcttgactggagggagtcacttcctcatcctgatgaacgggttgagtatgagttctggacaaatagcaacgatgagtgtgggccaaagtgtgacagccagatagaatttgtcaagaacttcaaaggagctgctcaaatacttgagcagaagggctacactatgttcaccccccactatataacttggtattgccctgaagcttttattttgagcaaacagtgcaagtcacagtgtatcaatcatgggaggtactgtgctccagatcctgagcaagacttcagtaaaggttatgatggtaaagatgtggtggttcaaaatcttcgccaagcttgcctgttcaaagttgccaatgaaagtggaaagccatggctttggtgggattatgttacggactttgctatccgctgcccgatgaaagagaagaaatataacaaggagtgtgcagataaagttatccaagcccttggtgttgatctcaataaagtagacaactgtattggagacactgaagctgatgtggacaacccagtgctgaaagctgagcaagatgcacagattggaaaaggctcccgtggagatgtaactatactgccaactcttgtgataaacaacagacagtatagagggaagttggacagaggagctgttctcaaggcaatttgtgcaggttttcaagagaccacagagccagcaatttgtttaactgaagatatacaaactaacgagtgcttagaaaacaatggtggttgctggcaggacaagagtgccaacataactgcatgcagggataccttccggggaagagtgtgcgaatgcccgttagttaatggtgtgaagttttctggagatggttatacgcattgtgaagcttctgcggctttacgctgcgaaatcaacaatggaggatgttggagagaaacacaggaaggaaggacatactctgcttgtattgatgatcattcacatggttgcaagtgcccatacggattcaggggtgatggagtcaagagctgtgaagatgttgatgagtgcaaggagaagctggcctgccaatgtcctggttgcaaatgcaaaaatacctggggcagttatgagtgcagctgtagtggtggttcgttgtacatgcgagagcatgacacatgtatcagtaagaatgttaaaacagaggtaagctggggctctgtttgggtaataattcttggattggttgctgctggagctggagggtatgccatttacaaatacagaatccggagatacatggattcagagattcgggctataatggcacaatacatgccattggataatcaaccaaacaacgttcatcatccagacatttaaagtgcctcttctgattgggttggttatatattagtaggttttatatttttgagtcacgtaacttatttggcttctcttcgacattgtaattctaaataaagaacaattttcataattatgtggcttttacattttatcttccggctggatttatttttgaagaattgagttcagggtgggtcggaaaatagttgggtaaacttgcccgatattaagtttttaaaattaaaaaaatttaaatttggatccggatgcatcattctgttctcatctctattgttaatttaagcttgtagaaaggtgcaggcttgggctttttgttgtgctggatcaaaaagtaggatcttaatttggttacatttctcggatttttcaaaccctcttgtttgactatcttcataaattttattgtttttaaacattatttaataaattttaagtaaaataatttttaaatttt

SEQ ID NO: 131 - DNA, 2647 bp, Gossypium hirsutum
aggaatggagtggggttatcaacggagcatcgacgtgttaaagtgaatcaggaaaaagacacatgtatttgatgcattaccctttcactttctacgttttgtcttatcagttttataggtgaaaataataatatgattagaaaaatggaatacaattttcctaaatttaattgatctaagcagcccctcttgcgtccttttttaaatcaaaktcsgtttacattacarctcctttmcttccacaacacttccaaatcttctttttctctytactttgaaaaagcttacaactttcttccaaatctttcttcttaaacttctgggtttttctttatacgaccaagcaaacgcctcattgccgtgtcgaaagcacaaaacaaacggaaaaattgagctcccaagaaggattgggaaacttgaccagcgaaaagaggagactttgatgctaagttattgttgattgaaagattcccccatcttgggttattattagagaaaaaaagtttctcctggaaagatgagggaaaattcttggtttktaatttgcatgtgggttttgttagtggggaattgtttggggaggtttgtggtggagaagaacagcttgaaggtgacttcgccggaatcaatcaaaggggtttatgagtgtgcgattgggaattttggggttcctcagtatgggggtaccttggttggcactgttgtttatcctaaagctaatcaaggcgcttgcaagtccttcgatgattttgacatctctttcaaatcaaagcctgggggattacccacttttctccttgttgatcgtggagattgtttcttcaccttgaaggcatggaatgctcagaaagctggagctgctgctattcttgttgctgacagcaaggatgagcccttgattaccatggatacccctgaagaagaaaatgctaatgctgaatacctgcagaacatcaccattccatcagcccttatcagtaaatcactaggggacagcctcaagaaggcccttaacggtggggagatggttaatatgaatcttgactggagggagtcacttcctcatcctgatgaacgggttgagtatgagttctggacaaatagcaacgatgagtgtgggccaaagtgtgacagccagatagaatttgtcaagaacttcaaaggagctgctcaaatacttgagcagaagggctacactatgttcaccccccactatataacttggtattgccctgaagcttttattttgagcaaacagtgcaagtcacagtgtatcaatcatgggaggtactgtgctccwgatcctgagcaagacttcagtaaaggttatgatggtaaagatgtggtggttcaaaatcttcgccaagcttgcctgttcaaagttgccaatgaaagtggaaagccatggctttggtgggattatgttacggactttgctatccgctgcccgatgaaagagaagaaatataacaaggagtgtgcagataaagttatccaagcccttggtgttgatctcaataaagtagacaactgtattggagacactgaagctgatgtggacaacccagtgctgaaagctgagcaagatgcacagattggaaaaggctcccgtggagatgtaactatactgccaactcttgtgataaacaacagacagtatagagggaagttggacagaggagctgttctcaaggcaatttgtgcaggttttcaagagaccacagagccagcaatttgtttaactgaagatatacaaactaacgagtgcttagaaaacaatggtggttgctggcaggacaagagtgccaacataactgcatgcagggataccttccggggaagagtgtgcgaatgcccgttagttaatggtgtgaagttttctggagatggttatacgcattgtgaagcttctgcggctttacgctgcgaaatcaacaatggaggatgttggagagaaacacaggaaggaaggacatactctgcttgtattgatgatcattcacatggttgcaagtgcccatacggattcaggggtgatggagtcaagagctgtgaagatgttgatgagtgcaaggagaagctggcctgccaatgtcctggttgcaaatgcaaaaatacctggggcagttatgagtgcagctgtagtggtggttcgttgtacatgcgagagcatgacacatgtatcagtaagaatgttaaaacagaggtaagctggggctctgtttgggtaataattcttggattggttgctgctggagctggagggtatgccatttacaaatacagaatccggagatacatggattcagagattcgggctataatggcacaatacatgccattggataatcaaccaaacaacgttcatcatccagacatttaaagtgcctcttctgattgggttggttatatattagtaggttttatatttttgagtcacgtaacttatttggcttctcttcgacattgtaattctaaataaagaacaattttcataattatgtggcttttacattttatcttccggctggatttatttttgaagaattgagttcagggtgggtcggaaaatagttgggtaaacttgcccgatattaagtttttaaaattaaaaaaatttaaatttggatccggatgcatcattctg

SEQ ID NO: 132 - DNA, 567 bp, Hordeum vulgare
ggagatttctcagacaccatgaaagagccactgaaagcaagcaggagtaagatattagttgtcttgcttgtcttcgccatggttactcaaggcttggtgatttgtgtaaaggggatagagaggaatgatatcgccggcaaggccgttagtgcaaaacccacccttggtgcaggcagcagcacaaccgtggacaaccaccatgccataccacgggaccagtatagtagccatggaggagaggacggatcaggtggcagtggtggtgatactacgaagaactagtgtcattctctgagactgccgttcacggagcatatatattctgatctctaacgtcatattgtatagatgtcagcagccctaattgttattattattatcttctgtacatgaaaataagctgctgaagggaagagtaatgtcgaagtaaaaacattcccacagaaggaagaagctatgttttattaaaaaaatatagaagctatatatgtaatagatgtgatattctcgtgtgtgtgtgtgcgcgcgcgcgcgcgcacgcgcgtgtgtaaggaaacttttatgatg

SEQ ID NO: 133 - DNA, 567 bp, Hordeum vulgare; identical to SEQ ID NO: 132

SEQ ID NO: 134 - DNA, 2206 bp, Hordeum vulgare
  misc_feature (1191)..(1193): n is a, c, g, or t
  misc_feature (1195)..(1195): n is a, c, g, or t
  misc_feature (1238)..(1238): n is a, c, g, or t
cggcacgaggctggatccctctcctcattgccaatcccgcctccctttcttcctcgcagcacccttatctcttctccggctcaagcctagcaaagcgctctccggccagcgagaaagcaagaaaagcagaggcatgaagatccagtgcgactcgtgcggggtcgcggcggccacggtggtgtgctgcgcggacgaggcggcgctgtgcgcgcgctgcgacgtggagatccacgccgccaacaagctcgccagcaagcaccagaggctcccgctcgacgcgctcggcgccaagctcccgcgctgcgacatctgccaggagaaggccgccttcatcttctgcgtcgaggacagggcgctcttctgccgcgactgcgacgagcccatccacgtcccaggcacgctctccgggaaccaccagcgctacctcgccaccggcatccgcgtcggcctcggccccgtctccacctgcgccgccggggaccacggcgcaagccacgacgccgaccaccacgccccgccaaaggtcgcctgcgaccaccagccgccggcccagcccgccgccagcgctcagcaggttccctcgccgccgcagttcctgccgcaggactgggccgtggacgagctcctgcagttctcggactacgagtccagcgacaagctgcacaaggactcgactctcggcttcaaggagctggagtggttcaccgccgacatggagctcttccacgaccacgcgcccaagggcggcagggcggccatggaggtacccgagttctttgcctcgcaggcggcagacgacgcggcctactacaggcagagcagagtcgccgccaccgccggcgtgcgccagagcaagaaggcccgcgtcgagatcgccgatgacgaggacttctttatcgtacctgatcttggctaagcgatactcctaggtttaggttctggtacttcctcgtgtgattttgcagtgttgttgtatacagagaggagctgtgtacaaaagctagtgttctgtcgaactgtgccctgtgcatcttaacgtagcatcgctgaactcaactgtgacatataataatcatccgaagatctgagctttgtgaaaaaaaaaaaaaaaaaactcgagggggggcccggtacccaattcgccctatagggagtcgtattacgcccgttcactggccgtcgttgacaaannnanagggagaaaagagaagaaagaaaaaagaaaggagggggggggnaggggaccaaaagcgccctaataggggcgacgcattaccccgcgtacattggggaggcgtgttagtaaggcgttgtctccgtagacttttgaaactggtgtcttgcaatccgtgtctcgggaatctatgagggcatttgctgtctatatttgtgtgacgaggtgcagtagtgcgatcacgacacgtctttggagagagccgcgcttgcataactgacaattgctggaagtatatctcatcatcggagcgtcatggttccttaatgagtagattctataatccgtacaggctcgtgactgtacagtgttatagcgtctctctaacgtctcgatagcactttcgtgacgttatatagaggatggtactggatatgttctatgcattctgatggtcattgcaacgttgtccgtgtagatatggtgctgtcgtgctccgtgttcaacacgtgctcggctttatatcgtcctcgcatcacgttcgctagtgacatagtggtcggtcagaactctatcaatatgtgagcgaggatctctgcgctgctcgccattacagtggatatatactgcagcggatatgatctcgtcggacgtctcgacgtccgcggtaaagtatgtaagcatctaggcttagtataatactaggtatgcgatactgagtcagtatcaccgtgtacagtaacgtacgatcttcaatacaaattacattcgtttgtccacttgattatatatgttgtagggatggttatatattttggaggtttatagtttattaatattgaatttatttgtatgtttgggaggaggtttatcgctcccgcgagcgtgcggcacctcccccccacccgcgtgtgcgccgcgcctatggtcccccatacctttagccaccccccaccgacctccctcttcgccccccgcacctgtcaatacctcgcatctcggcccgcccccagccccccgtagccctaccct

SEQ ID NO: 135 - DNA, 830 bp, Gossypium hirsutum
cccttttggtttataatttctaggataatttctccgcctaacaaaattaagatcaattttaatggctgcatcctcattcgattctcttccgtcatcgtcttcgttgatctgtttggtttcttcttcacttcggttttgttttgtcgatcgttttttaatttctaagctttcttctcatcttcagattcttagtcaaccttttacctgttattgacataataaaaaagtaaaatccaatcgaataggaatcgtctccaacatgggaaaacgtaaaactcagcgtaagaatgcgacgatgttagatagtgacgatgataatagtagtgtaagttcatcgtcaaccatgcgttctgatagaatgtcggtgtctgcttctgaagaagtagagtttaataaggatagtttacttgatgaagctgttgatgctttatatgaaaagaggggttctacacgggagaaggccttggcagtgattattgaggctttcaatagcaatttgcaacagggccagcagttcgtggagaggaagtaagttccttttttctaaatgttttcatctttctatcatttgctattgcaagaattgcagagaggattaatggcattgatctgtgacattttattgagctgtgatgagctgactaggatatcttaattagttccttaaaaatgggcatgtgaagaactatgatagcattttatagtgagatcaagcaatttattgtatgtcaaattccatattgttagatcgtttactttctattattaagagtattggtaagtatgggtgaaaatatttctcgtaatgcagaacatacggtttgaatact

SEQ ID NO: 136 - DNA, 1811 bp, Gossypium hirsutum
  misc_feature (930)..(930): n is a, c, g, or t
cccttttggtttataatttctaggataatttctccgcctaacaaaattaagatcaattttaatggctgcatcctcattcgattctcttccgtcatcgtcttcgttgatctgtttggtttcttcttcacttcggttttgttttgtcgatcgttttttaatttctaagctttcttctcatcttcagattcttagtcaaccttttacctgttattgacataataaaaaagtaaaatccaatcgaataggaatcgtctccaacatgggaaaacgtaaaactcagcgtaagaatgcgacgatgttagatagtgacgatgataatagtagtgtaagttcatcgtcaaccatgcgttctgatagaatgtcggtgtctgcttctgaagaagtagagtttaataaggatagtttacttgatgaagctgttgatgctttatatgaaaagaggggttctacacgggagaaggccttggcagtgattattgaggctttcaatagcaatttgcaacagggccagcagttcgtggagaggaaatttgctacattactgcatcagtgtttgaattctatcaaaaaggggtccagcaaagagatatctttggcatcccataccattgggttgctggccttaactgttggtccaggagataatgcacgggaaattttggaagaatcaatgattcctctttcacaggcttttaaatctggttctgatccttctaagacagcttcattactggagtgtatggctgtcatcacatttgttgggggcaatgatccagaagatacagaaaaatcaatgcaaattatatggcaagtggttcatcctaaattaggttctaacgtggttgctgtgaagccttctgcagctgtaataacagcagttgtgtctgcgtggtcatttcttctgacaaccatggatggttggaggcttantccgaaactttggcaagagtccattacatatttgtctagtttgctagataaggatgaccgatctgtccgcattgctgctggtgaagcactggcagtaatttttgagatgggaagcttagaaaaatttgctgccgaaactaaaggttccagtgatggctcagtttcagaaggaaataaatctaaagaaggattctcatatatacaaggactgaagggaaaaattttgaatcaagtcagagacctctcagtggaagctggtggtaaaggttctgccaagaaagatctcaacaaccagaggaacttgtttaaagatgtgttagagttccttgaggattgttatagtcccaacacatcaatgaagattggtggggacttactgcagacatcatcatggtctcagttgattcagttgaactttttgaggtgctttcttgctggaggcttcactaaacacatgcaggaaaatgaattcctacaagatatttttgggttcactccaaataaaaggaatcttctaggcagtgaacatatgtccaacggtgagaagagaatgtacaagtcaccgaattcagccctcaacaaagcaagaacccagctattgaataagcagcggatgctatctgcgggtaggaactttgggcactatgctgttaatgtaggcgatgaagattcataagctgctgccaagccagaccaggaacaccattagttcacctgatacgccaacatattgtaatctaaatctgataagcgacgaaccattttggttgtattggcgtggcttcatatacaacaaataaacttcattcttgttgtactctttatgtgatttatttaaaggcatattcctgtcatgattcatcatgtttttgcattcctcc

SEQ ID NO: 137 - DNA, 2110 bp, Gossypium hirsutum
attttttttccccttttggtttataatttctaggataatttctccgcctaacaaaattaagatcaattttaatggctgcatcctcattcgattctcttccgtcatcgtcttcgttgatctgtttggtttcttcttcacttcggttttgttttgtcgatcgttttttaatttctaagctttcttctcatcttcagattcttagtcaaccttttacctgttattgacataataaaaaagtaaaatccaatcgaataggaatcgtctccaacatgggaaaacgtaaaactcagcgtaagaatgcgacgatgttagatagtgacgatgataatagtagtgtaagttcatcgtcaaccatgcgttctgatagaatgtcggtgtctgcttctgaagaagtagagtttaataaggatagtttacttgatgaagctgttgatgctttatatgaaaagaggggttctacacgggagaaggccttggcagtgattattgaggctttcaatagcaatttgcaacagggccagcagttcgtggagaggaaatttgctacattactgcatcagtgtttgaattctatcaaaaaggggtccagcaaagagatatctttggcatcccataccattgggttgctggccttaactgttggtccaggagataatgcacgggaaattttggaagaatcaatgattcctctttcacaggcttttaaatctggttctgatccttctaagactgcttcattactggagtgtatggctgtcatcacatttgttgggggcaatgatccagaagawacagaaaaatcaatgcaaattatrtggcaaktggttcatcctaaattaggttctaacgtggttgctgtgaagccttctgcagctgtaataacagcagttgtgtctgcgtggtcatttcttctgacaaccatggatggttggaggcttagtcccaaactttggcaagagtccattacatatttgtctagtttgctagataaggatgaccgatctgcccgcattgctgctggtgaagcactggcagtaatttttgagatgggaagcttagaaaaatttgctgccgaaactaaaggttccagtgatggctcagtttcagaaggaaataaatctaaagaaggattctcatatatacaaggactgaagggaaaaattttgaatcaagtcagagacctctcagtggaagctggtggtaaaggttctgccaagaaagatctcaacaaccagaggaacttgtttaaagatgtgttagagttccttgaggattgttatagtcccaacacatcaatgaagattggtggggacttactgcagacatcatcatggtctcagttgattcagttgaactttttgaggtgctttcttgctggaggcttcactaaacacatgcaggaaaatgaattcctacaagatatttttgggttcactccaaataaaaggaatcttctaggcagtgaacatatgtccaacggtgagaagagaatgtacaagtcaccgaattcagccctcaacaaagcaagaacccagctattgaataagcagcggatgctatctgcgggtaggaactttgggcactatgctgttaatgtaggcgatgaagattcataagctgctgccaagccagaccaggaacaccattagttcacctgatacgccaacatattgtaatctaaatctgataagcgacgaaccattttggttgtattggcgtggcttcatatacaacaaataaacttcattcttgttgtactctttatgtgatttatttaaaggcatattcctgtcatgattcatcatgtttttgcattcctccaaaaaaaaaaaaaaaaacctcgatgctatgagatcgctttttcaagaaatgtatcaaatacttgaagccatgaagagtaggaacctagagcctgccctgaaatgggcagccacaaactccgataaactgaaagaaaatggttcagacctcctgttggggctccatcakttgcagtttgtgaaatactacagaagggaagcararaagaagcactcaagtatgcaagaactaacttcgttccttttgccggaaaccatatggccgagatccagaaactcatggggtgtct

SEQ ID NO: 138 - DNA, 1368 bp, Solanum lycopersicum
gcacgagaaatgggagaagaaattagtaacaaacagatcttattaaaagattatgtaaatggatttccaaaagaatcagatatggaattaagaattagtagtatgaaattgaaagttccagaagattccaatagtgttttggttaaaaatctttatttatcttgtgatccatatatgagacctcgtatgaagaaaactgaaggcagttatactgattcctttactcctggctctcctattgtggggtttggtgtggctaaagttgtggattcagctcatccaaagttcaagaaagatgagttagtttggggaataactggatgggaagaatacagtgtcatcaaggctcctgagactctctttaaaattcacaatacggatgtgccgctttcttactatacaggaatcctagggatgcccgggataactgcttatggaggtttttatgagctatgctccccaaagaaaggagaaactgtatatgtctctgctgcgtctggagctgttggtcagctcgttggacaattcgctaagctaataggttgctatgttgttggaagtgctggaagcaaagaaaaggttgagcttttgaagaacaaatttggtttcgatgaagcatttaactataaagaggaacaagatttatcagcagctttgaaaaggtacttcccagatggaattgatatctactttgagaacgttggaggaaagatgcttgacgcggttcttctcaacatgagagtccatggacgaatagctgtatgtgggatgatctcacaatacaacctcgagcaaaacgaaggtgttcacaacttgttctgcctcatttcaaaacgactccgtatgcaaggatttttggctgttgattactttcccctctacaaaaaatttgtagaaatggttactccacacataaaagaagggaaggtaacctatgtggaggacatagctgaaggaattgaaagtgcaccaggtgctctagttggcctcttctctggtcgaaacgttggaaaacaggtagtgctcgttgctcgtgaataaacttatcgagtgtgtttgatacgatggaagatactttcgtcgtgttactaagtaccaacaaataactctctcatgttcatcatcaagattggatgtgtaattttctctatgatacaaacatatcttatcaagtatgttaagtttgtatagaccaaaagttgtgttgagtttggagttggtgttggtgaggattgttttatcagtattttggacatgattttaacttgaatttggtcattaaaatccattttttatgtgacaaaaatgttaaagaagaaaagaaagacaattttagtaggtttgaagacataatatgatgtatgaaat

SEQ ID NO: 139 - DNA, 1409 bp, Solanum lycopersicum
  misc_feature (2)..(5): n is a, c, g, or t
gnnnntacggccgggggtgtatgtgtaaaaaaaaaaattagagtgaaaaaatgggagaagaaattagtaacaaacagatcttattaaaagattatgtaaatggatttccaaaagaatcagatatggaattaagaattagtagtatgaaattgaaagttccagaagattccaatagtgttttggttaaaaatctttatttatcttgtgatccatatatgagacctcgtatgaagaaaactgaaggcagttatactgattcctttactcctggctctcctattgtggggtttggtgtggctaaagttgtggattcagctcatccaaagttcaagaaagatgagttagtttggggaataactggatgggaagaatacagtgtcatcaaggctcctgagactctctttaaaattcacaatacggatgtgccgctttcttactatacaggaatcctagggatgcccgggataactgcttatggaggtttttatgagctatgctccccaaagaaaggagaaactgtatatgtctctgctgcgtctggagctgttggtcagctcgttggacaattcgctaagctaataggttgctatgttgttggaagtgctggaagcaaagaaaaggttgagcttttgaagaacaaatttggtttcgatgaagcatttaactataaagaggaacaagatttatcagcagctttgaaaaggtacttcccagatggaattgatatctactttgagaacgttggaggaaagatgcttgacgcggttcttctcaacatgagagtccatggacgaatagctgtatgtgggatgatctcacaatacaacctcgagcaaaacgaaggtgttcacaacttgttctgcctcatttcaaaacgactccgtatgcaaggatttttggctgttgattactttcccctctacaaaaaatttgtagaaatggttactccacacataaaagaagggaaggtaacctatgtggaggacatagctgaaggaattgaaagtgcaccaggtgctctagttggcctcttctctggtcgaaacgttggaaaacaggtagtgctcgttgctcgtgaataaacttatcgagtgtgtttgatacgatggaagatactttcgtcgtgttactaagtaccaacaaataactctctcatgttcatcatcaagattggatgtgtaattttctctatgatacaaacatatcttatcaagtatgytaagtttgtatagaccaaaagttgtgttgagtttggagttggtgttggtgaggattgttttakcagtattttggacatgattttaacttgaatttggtcattaaaatccattttttatgtgwcaamaatgktaaagargaaaagaaagacaattttagtaggtttgaagacataatatgatgtatgaaat

SEQ ID NO: 140 - DNA, 1979 bp, Vitis vinifera
tctccaaatcgctgtgaattctgtgttaactcggtgacgcggatctgagttccttttcttttgcttctgtagaggaattgtacagtttggaaagctttcattcatcacttagaaattttgttgtaaataacttggcatgggagttgtgactgtttctagctcagcttctcgaaccccatttggattgaacgcaaaattttcaaatcatcaaacccctttgaggaggccccttgttttggcattcaaagcagataaagccaagaacatagctctggttactccccatgagccaatccctttacctatagagacttctaaagatcataagaagagacttggtagggcttccaagccttcaaagagagtaaaagcggtcagtacagatgaagtatcgccatgtagtgtagaattggattacaatgaagctgctgccaaacttgaaaatatatacaagcttagccctgcaactgatgtttcagaggcagaagatttagaacgtgtcgttaggagagggcgacagaggaggaagagagttactttgcctgatgacaaggcagagaaggaaattagtgataatgtagtgaggatccataataagaaaccgaaacgattgagtcttgagaagaggattgctttgagtaagatgaagcaagaaaaagcagttgcttcaattcaaaagaaaagggacagtaaaaatgaagatgaaaatattgatatgcttgttagggagtactcggcttctactgacttggtcagcttggactggragaaaatgaagatrccacccgtgctkmyytcctcagagcatgcatggctattcaagctaatgcagcccatgaagggactccttgaagtgaaagacaacttacaaaaggatttggggagagaaccaacygayggggaattagcagaggccatgagtatgagtgcagttcaagtaagaagatacatggaagttggtcaagcagcaagaaacaagctgattaagcacaatcttcgactggttttgtttgtaatcaacaagtactttcaagagtttgccaatggcccaaagtttcaagacctgtgtcaagcaggagtgaagggccttatcacagccatcgatcgctttgaaccaaaaaggagtttccggctctcaacctatggtctgttttggattaggcatgccatcatgcgctccatgacactctcaagctttacacgcgtctcctttggccttgagtcggttagggtagaaatccaaagagcaaaactagagttgttgttcaagctccaaagattaccaacagaggaagagataatagaaaaggtcggaatctcccctgagagrtaccatgaagtgatgagggcctcaaaatccgtcctctctctccatgcaaggcatgcaaccacacaagaagagtacatcagtggaattacagatgttgaaggtgttgggggtgatagggggcggcaacttgctcttctcagacttgctcttgatgatgtgctcgattctctgaagccaaaggagagcttggtgatgagacagagatatggtcttgatggtaagggtgatcggacactgggggagattgcaggaaacctaagcatctcaagagaaatggttcgaaagcacgaggtgaaggctctcatgaagctcaagcatccagcacgagtggattatcttcgccaatacatattctaaaataatcgaacttcatctgccttgcttatcaatacgtcttcatatactcctttgcttcctcccaatcatctctattcatcagccatggttgtatactaattgatctgcaccatagtcttttaactaccagaatatacaagtttcataaattcatacagtgtaatctttatttggagactcagagattgcaaatctccaagtatatatcacatcttaaatcttattttctctgtattaaggagacgatgatgttatatatacaggttgattatacgtgcctaaaccttccaac

SEQ ID NO: 141 - DNA, 2081 bp, Vitis vinifera
ctctctaccgttaattttctggagtagagctcgtggacgccttaatttgaggatttatgattttggtatttaaactccggtacttttaacagcagagattctctccaaatcgctgtgaattctgtgttaactcggtgacgcggatctgagttccttttcttttgcttctgtagaggaattgtacagtttggaaagctttcattcatcacttagaaattttgttgtaaataacttggcatgggagttgtgactgtttctagctcagcttctcgaaccccatttggattgaacgcaaaattttcaaatcatcaaacccctttgaggaggccccttgttttggcattcaaagcagataaagccaagaacatagctctggttactccccatgagccaatccctttacctatagagacttctaaagatcataagaagagacttggtagggcttccaagccttcaaagagagtaaaagcggtcagtacagatgaagtatcgccatgtagtgtagaattggattacaatgaagctgctgccaaacttgaaaatatatacaagcttagccctgcaactgatgtttcagaggcagaagatttagaacgtgtcgttaggagagggcgacagaggaggaagagagttactttgcctgatgacaaggcagagaaggaaattagtgataatgtagtgaggatccataataagaaaccgaaacgattgagtcttgagaagaggattgctttgagtaagatgaagcaagaaaaagcagttgcttcaattcaaaagaaaagggacagtaaaaatgaagatgaaaatattgatgtgcttgttagggagtactcggcttctactgacttggtcagcttggactggaagaaaatgaagataccacccgtgcttcctccctcagagcatgcatggctattcaagctaatgcagcccatgaagggactccttgaagtgaaagacaacttacaaaaggatttggggagagaaccaaccgatggggaattagcagaggccatgagtatgagtgcagttcaagtaagaagacacatggaagttggtcaagcagcaagaaacaagctgattaagcacaatcttcgactggttttgtttgtaatcaacaagtactttcaagagtttgccaatggcccaaagtttcaagacctgtgtcaagcaggagtgaagggccttatcacagccatcgatcgctttgaaccaaaaaggagtttccggctctcaacctatggtctgttttggattaggcatgccatcatgcgctccatgacactctcaagctttacacgcgtctcctttggccttgagtcggttagggtagaaatccaaagagcaaaactagagttgttgttcaagctccaaagattaccaacagaggaagagataatagaaaaggtcggaatctcccctgagaggtaccatgaagtgatgagggcctcaaaatccgtcctctctctccatgcaaggcatgcaaccacacaagaagagtacatcaatggaattacagatgttgaaggtgttgggggtgatagggggcggcaacttgctcttctcagacttgctcttgatgatgtgctcgattctctgaagccaaaggagagcttggtgatgagacagagatatggtcttgatggtaagggtgatcggacactgggggagattgcaggaaacctaagcatctcaagagaaatggttcgaaagcatgaggtgaaggctctcatgaagctcaagcatccagcacgagtggattatcttcgccaatacatattctaaaataatcgaacttcatctgccttgcttatcaatacgtcttcatatactcctttgcttcctcccaatcatctctattcatcagccatggttgtatactaattgatctgcaccatagtcttttaactaccagaatatacaagtttcataaattcatacagtgtaatctttatttggagactcagagattgcaaatctccaagtatatatcacatcttaaatcttattttctctgtattaaggagacgatgatgttatataatactggttgattatacgtgcctaaaccttcaaac

SEQ ID NO: 142 - DNA, 1021 bp, Hordeum vulgare
acggcacagcaggcggaggagaagagaaagctctcgtgctcgcgcgacgacgacgacggcgacggcgacctcggccgcggcgacgatgagccccatccgcgccctcatcgtcctcgccgccgtcctggcggcgtgcctccgccccgcggcagcggcggaccagcccggatccggcgagggacacaccatcgccggccgcatcaagatcgaagctgcaaggggctttggtcttccagccaagacatcaaacacgaaagtgatacttaatggtggtcagaaagttacgttcgccaggccagacggctactttgcttttcacaacgtgcctgctgggactcatttgatcgaagtttcctcacttggctacttcttctcaccagttcgagtggacatcagtgccaggaatcctgggcatattcaagcagcattgactgagaacagaagagtcctaaatgagctggttttggaacctctgaaagaagagcaatactatgagatgagggagcctttcaacattttgtcacttttgaagagccccatgggtatgatggtcggttttatggtcgtaatggtctttgttatgcccaagatgatggagaacatagatccggaggagataaagcaagctcaagaacaaatgaggaactcacctgcatccttttctggcttgctagccagggcaaacagctagatgtagaacatgggaacaatatgttgtttaagtgtactataaactgcttcatgctcgagtcagattatttttttctctgggagactgggacaaggtgtaaactcttttacccacttttaatgtgttgtaagatgtaataggtttgtaatggagaaccttctgaaacacctggctgaagtagtcaaccagtatttatagcttacatcgaggtcagtgtgtcaaatctttttacccgtttgaatatttgatttgatgccttgttgagcgagtcatcgactatgggtagagacattcctgatgctgacctatggtcaataacaaactccatca

SEQ ID NO: 143 - DNA, 3027 bp, Solanum lycopersicum
  misc_feature (13)..(13): n is a, c, g, or t
gttataagattcncgagacaaactatattggtaggtgtctcctaaaaaaagaaccttttttcctctataaatatatatattttttttacattttttccatctatttctctttatatatatagcaaagttcataaaacaagagaggacaatatacacaattttaattttttttttttgagaaaaaattaattttatttttttagagttatgggagataatagaggattaggtgtttttggagtatcaatgtgtggtgcagcacaagaaatagaacaattatcaagagaaagtagtcattatagtctttctactggaattttaccttcacttggtgcaagaagtaacagaagagttaagcttaaaagatttattatttcaccttatgatcgacaatacaggttatgggagacatttctagttgtgctggttgtttacactgcttgggtgtccccgttcgagtttggctttctaggaaaaccagcagggccacttgctaagacggacaatgtagtcaatggattcttcgcgattgatatcattcttaccttcttcgtagctttcttggatagaaccacttatctacttgtcgatgaacataaaaagattgcttggaagtatatgagtacttggttcttattcgatgtcatatcaacaatcccttcagaacttgctgtgaagatttctccaaaacctttacgtcagtatggattattcaatatgcttcgtttgtggcgtctaagaagagttagtgcattgtttgcaagattggagaaagataggaacttcaattacttttgggttcgatgtgcaaagcttgtttgtgtcactctttttgctgttcattgtgccggatgcttttattatcttatcgcggttcattatcctgatccaaagaggacatggatcggagttgctatggatgacttccttaatcagagcttatggattcgttatgtcacttctatttattggtcgataactactctcactacagtcggttatggagatctgcatccagagaatacgcgggaaatgatctttgatattttctacatgctctttaacttgggattgacagcatacttaataggaaatatgactaacttggttgtgcacgggacgagtaggactagaaaatttagagatacaattcaagctgcttcgagctttgcacagaggaaccaattgcctgctcgactccaagatcagatgcttgcacacttgtgcttgaagttcagaacagactcggaagggctgcagcagcaagagacactcgagtctcttcctaaagctatccgttcaagcgtttcacattttcttttctactctttagtagataaggtttacctgtttcgtggagtgtcaaatgatctactcttccagctggtctccgagatgaaggcagagtactttcctcccaaagaggatgtcattttgcagaatgaagcaccaaccgacttctatattcttgtaacaggagctgtggatctagtagtgcttaaaaacggagttgaacaggttgttggggaggtcagggctggtgatctttgtggtgaaatcggggttctttgttataggcctcaactatttacagtacgaacgaagagactgtgccagctactacgtatgaatcgtaccacatttctgaatatcgtccaggccaatgttggggacgggacaataatcatgaataatctacttcagcatttgaaggaaatgaagaatccaattatggagggtgttctacttgagaccgagcatatgttagctcgcggtagaatggacttgcctctcaccctttgctttgcaacacttagaagtgatgacttattgttgcatcacttgttaaagcgcggtcttgatccaaatgaatcagataacaatggaagatccgcgttgcatatcgctgcgtctaaaggcattgagaactgtgtggttcttctgctcgatttcggggctgatcccaatagtagagattcagaaggcaatgtgccattgtgggaggctatcatggggaagcatgaatcagttatccagttactcgttgacaacggtgctaaactatcagctggtgatgtgggacatttcgcctgcgttgctgttgaacaaaacaacttgagtttgctcaaggagattgtccgttatggcggggatgtcacgcttcccaagatcaacggttcatcagctctccatgtagctgtctgtgaaggtaacatagaaatagtaaagtacctcttggatcgaggggctaacgttgatcaaccagacgaacataattggacccctcgggaccttgctgagcaacaaggacatgaagacatcaaagaactcttcgaatccagagtaatgatgagaactcgatccgttgatcctatcccagaggaacgaggggttcgatttcttggtaggttcaaaagtgagccaacaatctcccctgcatcacatggagtctcatttctaggactagatggatcattaggacgatcacgtcctagacgcaggtctaataacttccacaactcattattcgggataatgtcagcaaagcagaccaatgcaagcgacgtgcttttatctgcaaacgacactaatgtaagtagcacgacaaccaagacttatgctcctcgagtgatcgtgtgttgccctgagaaaggagacaatgggggaaaactcattttactcccacagagttttaaagagctacttcaaattggttctagtagatatggtatctctcaggccaaagttgttagcaaagatggagctgaaatcgatgaaatcgagttgatcagagatggtgatcgtttagtttttgttagagataaagaaaacaatatcgatgaagctaaatcatcataattgtagtgagttgaggtgtaaaccaaaattgttctttatttttgtagtgaattgagtgtaaactagttcacagccaatttgtggaacatgtaaagctcagaatgagaaaatatgaatgtacattatcagatacctcttttgtctaatatacaaatattcatagttcag

SEQ ID NO: 144 - DNA, 3027 bp, Solanum lycopersicum
  misc_feature (13)..(13): n is a, c, g, or t
gttataagattcncgagacaaactatattggtaggtgtctcctaaaaaaagaaccttttttcctctataaatatatatattttttttacattttttccatctatttctctttatatatatagcaaagttcataaaacaagagaggacaatatacacaattttaattttttttttttgagaaaaaattaattttatttttttagagttatgggagataatagaggattaggtgtttttggagtatcaatgtgtggtgcagcacaagaaatagaacaattatcaagagaaagtagtcattatagtctttctactggaattttaccttcacttggtgcaagaagtaatagaagagttaagcttaaaagatttattatttcaccttatgatcgacaatacaggttatgggagacatttctagttgtgctggttgtttacactgcttgggtgtccccgttcgagtttggctttctaggaaaaccagcagggccacttgctaagacggacaatgtagtcaatggattcttcgcgattgatatcattcttaccttcttcgtagctttcttggatagaaccacttatctacttgtcgatgaacataaaaagattgcttggaagtatatgagtacttggttcttattcgatgtcatatcaacaatcccttcagaacttgctgtgaagatttctccaaaacctttacgtcagtatggattattcaatatgcttcgtttgtggcgtctaagaagagttagtgcattgtttgcaagattggagaaagataggaacttcaattacttttgggttcgatgtgcaaagcttgtttgtgtcactctttttgctgttcattgtgccggatgcttttattatcttatcgcggttcattatcctgatccaaagaggacatggatcggagttgctatggatgacttccttaatcagagcttatggattcgttatgtcacttctatttattggtcgataactactctcactacagtcggttatggagatctgcatccagagaatacgcgggaaatgatctttgatattttctacatgctctttaacttgggattgacagcatacttaataggaaatatgactaacttggttgtgcacgggacgagtaggactagaaaatttagagatacaattcaagctgcttcgagctttgcacagaggaaccaattgcctgctcgactccaagatcagatgcttgcacacttgtgcttgaagttcagaacagactcggaagggctgcagcagcaagagacactcgagtctcttcctaaagctatccgttcaagcgtttcacattttcttttctactctttagtagataaggtttacctgtttcgtggagtgtcaaatgatctactcttccagctggtctccgagatgaaggcagagtactttcctcccaaagaggatgtcattttgcagaatgaagcaccaaccgacttctatattcttgtaacaggagctgtggatctagtagtgcttaaaaacggagttgaacaggttgttggggaggtcagggctggtgatctttgtggtgaaatcggggttctttgttataggcctcaactatttacagtacgaacgaagagactgtgccagctactacgtatgaatcgtaccacatttctgaatatcgtccaggccaatgttggggacgggacaataatcatgaataatctacttcagcatttgaaggaaatgaagaatccaattatggagggtgttctacttgagaccgagcatatgttagctcgcggtagaatggacttgcctctcaccctttgctttgcaacacttagaagtgatgacttattgttgcatcacttgttaaagcgcggtcttgatccaaatgaatcagataacaatggaagatccgcgttgcatatcgctgcgtctaaaggcattgagaactgtgtggttcttctgctcgatttcggggctgatcccaatagtagagattcagaaggcaatgtgccattgtgggaggctatcatggggaagcatgaatcagttatccagttactcgttgacaacggtgctaaactatcagctggtgatgtgggacatttcgcctgcgttgctgttgaacaaaacaacttgagtttgctcaaggagattgtccgttatggcggggatgtcacgcttcccaagatcaacggttcatcagctctccatgtagctgtctgtgaaggtaacatagaaatagtaaagtacctcttggatcgaggggctaacgttgatcaaccagacgaacataattggacccctcgggaccttgctgagcaacaaggacatgaagacatcaaagaactcttcgaatccagagtaatgatgagaactcgatccgttgatcctatcccagaggaacgaggggttcgatttcttggtaggttcaaaagtgagccaacaatctcccctgcatcacatggagtctcatttctaggactagatggatcattaggacgatcacgtcctagacgcaggtctaataacttccacaactcattattcgggataatgtcagcaaagcagaccaatgcaagcgacgtgcttttatctgcaaacgacactaatgtaagtagcacgacaaccaagacttatgctcctcgagtgatcgtgtgttgccctgagaaaggagacaatgggggaaaactcattttactcccacagagttttaaagagctacttcaaattggttctagtagatatggtatctctcaggccaaagttgttagcaaagatggagctgaaatcgatgaaatcgagttgatcagagatggtgatcgtttagtttttgttagagataaagaaaacaatatcgatgaagctaaatcatcataattgtagtgagttgaggtgtaaaccaaaattgttctttatttttgtagtgaattgagtgtaaactagttcacagccaatttgtggaacatgtaaagctcagaatgagaaaatatgaatgtacattatcagatacctcttttgtctaatatacaaatattcatagttcag

SEQ ID NO: 145 - DNA, 2569 bp, Nicotiana tabacum
tcgtgaaaatccaataaaggttagatttttggcaatattatgttacccatgtttgaaaaaattgagcttttagtcatttttgattatccaattttgttgcagaaagaatcttggaggacagttttagccttagcttatcagagtttaggtgtggtgtatggagatttgagcacttcacctttgtatgtatacaagagcacatttgcagaggatattcaacattcagagtctgatgacgagatatttggagttttatcatttgtgttttggacattaactcttattccattgcttaaatatgtgttcatagtattaagagctgatgataatggtgaaggtgggacttttgccttgtattccttattgtgccgtcatgcccgtgtcagtactttgcctaatggccaattggctgatgaggatttatatgagtacaagaatgatagaaatttgtcagctgataggattggaatgagcttgaaatcaactcttgagaaacacagatttttgaagaaaattttgctcattttagctttgattgggacttgtatggttattggtgatggagtccttactcctgcaatctcagtgttctctgctgtctctggacttgaactttcaatggcaaagcatcatcaccaatatgtagaagttccagttgcttgtgtgatactcgtgttcttattttttctccaacactatgggacgcatcgaataggatttctatttgcaccgattgtgattacgtggcttttgtgcattagtgcaattgggctatacaacatcttcctctggaaccctcatgtttaccaagcattatctccttactacatgtacaaattcttgaagaagacccaaagaggaggatggatgtccctcggtgggattttattatgtataacaggttcagaagctatgtttgctgatcttggacacttttcgcagctgtctattcagatagcttttacgtttgttgtctacccgtcattaattcttgcttatatgggacaagctgcgtatctttccaagcatcatgttatccaaggtgattaccacattgggttctatgtatcagtgcctgaaaaactacggtatcctgttctggctattgcgatacttgctgcagtggttggaagccaggccatcatcactgggacgttttccataatcaagcaatgctctgctttaggttgtttcccaagggtcaaaatagtacatacatcgtctaaaatccatggccagatttacattccagagataaactggacgttgatgttgctatgcttggcagttactattggcttccgtgacacgaaacacataagcaatgcatcaggtctggcagttataactgttatgctggtcactacgtgctttatgtctttggtcattgtcctgtgctggcacaaaaacgtgttactcgccatttgctttatattcttctttggttccattgaagccctctacttttcagcttccctaatcaagttcctcgaaggggcctgggtaccaatcgttctctctttgatatttctagttgtcatgtatagttggcattacggcaccctgaaaaagtacgagtttgatgttgaaaacaaaattcccatcaactggctgctcaccttgagtcccaacctgggtattacacgggtccgtggcattggcctcatccacaccgagcttgtttcaggaattccagcaattttctcacatttcgtcaccaacctacctgctttccaccaggttcttgttttcctttgcgtcaagtccgtcccagtacctcacgtgagacctgaagaaaggttcttggtgggaagaattggacccaaagagtaccgcgtctacagatgtatagcacgatatggttatcgagacattcacatggacgacgtagagtttgaaaaggatctagtttgtagcatagctgaattcatccgctcagagggaccagcacagagttttgaaactgttgaaggtatagacgacaacgaaaaactgacagttattggaacaacttcaacacatgttgatggagtaacaatgtgcgaggatgtagacactaaagatacagaaatgatcgagatcagttcaccagaagtgccaagaaagagagtgagatttctggtgccagagagtccacaaatggatttaagcgttcgagcagagttgcaagaactgatggaagcgcgggaagcaggcatggcgtttatacttggacattgttatgtaagagctaaaaggggttcaagtttgataaaaaaactggtggttgacataggatatgactttttgagaaggaattgtcgcgggccaacctatgcattgagcttccctcgtgcttcaactttggaggttggaatgatttaccatgtataatttgtgctttccgtttctatttaaaggatagaactgtastatatgctttttttcttcttcttacttttgtatttcaaatgtgaaagctgtaaatgttgtgctggtacatgaattttgctttgtacaatgcaataccacgaaacaaaatactgarcttasaggcatgtattgaataaagggctgaaaatatgagttt

SEQ ID NO: 146 - DNA, 2569 bp, Nicotiana tabacum
tcgtgaaaatccaataaaggttagatttttggcaatattatgttacccatgtttgaaaaaattgagcttttagtcatttttgattatccaattttgttgcagaaagaatcttggaggacagttttagccttagcttatcagagtttaggtgtggtgtatggagatttgagcacttcacctttgtatgtatacaagagcacatttgcagaggatattcaacattcagagtctgatgacgagatatttggagttttatcatttgtgttttggacattaactcttattccattgcttaaatatgtgttcatagtattaagagctgatgataatggtgaaggtgggacttttgccttgtattccttattgtgccgtcatgcccgtgtcagtactttgcctaatggccaattggctgatgaggatttatatgagtacaagaatgatagaaatttgtcagctgataggattggaatgagcttgaaatcaactcttgagaaacacagatttttgaagaaaattttgctcattttagctttgattgggacttgtatggttattggtgatggagtccttactcctgcaatctcagtgttctctgctgtctctggacttgaactttcaatggcaaagcatcatcaccaatatgtagaagttccagttgcttgtgtgatactcgtgttcttattttttctccaacactatgggacgcatcgaataggatttctatttgcaccgattgtgattacgtggcttttgtgcattagtgcaattgggctatacaacatcttcctctggaaccctcatgtttaccaagcattatctccttactacatgtacaaattcttgaagaagacccaaagaggaggatggatgtccctcggtgggattttattatgtataacaggttcagaagctatgtttgctgatcttggacacttttcgcagctgtctattcagatagcttttacgtttgttgtctacccgtcattaattcttgcttatatgggacaagctgcgtatctttccaagcatcatgttatccaaggtgattaccacattgggttctatgtatcagtgcctgaaaaactacggtatcctgttctggctattgcgatacttgctgcagtggttggaagccaggccatcatcactgggacgttttccataatcaagcaatgctctgctttaggttgtttcccaagggtcaaaatagtacatacatcgtctaaaatccatggccagatttacattccagagataaactggacgttgatgttgctatgcttggcagttactattggcttccgtgacacgaaacacataagcaatgcatcaggtctggcagttataactgttatgctggtcactacgtgctttatgtctttggtcattgtcctgtgctggcacaaaaacgtgttactcgccatttgctttatattcttctttggttccattgaagccctctacttttcagcttccctaatcaagttcctcgaaggggcctgggtaccaatcgttctctctttgatatttctagttgtcatgtatagttggcattacggcaccctgaaaaagtacgagtttgatgttgaaaacaaaattcccatcaactggctgctcaccttgagtcccaacctgggtattacacgggtccgtggcattggcctcatccacaccgagcttgtttcaggaattccagcaattttctcacatttcgtcaccaacctacctgctttccaccaggttcttgttttcctttgcgtcaagtccgtcccagtacctcacgtgagacctgaagaaaggttcttggtgggaagaattggacccaaagagtaccgcgtctacagatgtatagcacgatatggttatcgagacattcacatggacgacgtagagtttgaaaaggatctagtttgtagcatagctgaattcatccgctcagagggaccagcacagagttttgaaactgttgaaggtatagacgacaacgaaaaactgacagttattggaacaacttcaacacatgttgatggagtaacaatgtgcgaggatgtagacactaaagatacagaaatgatcgagatcagttcaccagaagtgccaagaaagagagtgagatttctggtgccagagagtccacaaatggatttaagcgttcgagcagagttgcaagaactgatggaagcgcgggaagcaggcatggcgtttatacttggacattgttatgtaagagctaaaaggggttcaagtttgataaaaaaactggtggttgacataggatatgactttttgagaaggaattgtcgcgggccaacctatgcattgagcttccctcgtgcttcaactttggaggttggaatgatttaccatgtataatttgtgctttccgtttctatttaaaggatagaactgtagtatatgctttttttcttcttcttacttttgtatttcaaatgtgaaagctgtaaatgttgtgctggtacatgaattttgctttgtacaatgcaataccacgaaacaaaatactgarcttasaggcatgtattgaataaagggctgaaaatatgagttt

SEQ ID NO: 147 - DNA, 2635 bp, Medicago sativa
acattaagccataaaaagaaacacaaatgttgggaggagaagcagatcgagtgagcatagaggatgagacagaaacaacaaaggagattacggagaaaaagctgaaagatcgaaaggtgtcatgggcaaaactacgtcgtgtagactccctcaatttagaagctggaagagtttctatgaatgcaaaccacaattccaaggtgggttggagcgtgacattgactttggcatttcaaagcataggaattgtatatggtgatattggtacatctccactttatgtgtatgcaagtactttcgctaaagggattaaaaacaacgatgacattcttggagtattgtctctcataatctacactattgtgcttatccccatgctcaaatatgttttcatcgtcttatgggctaatgacaatggcaatggtggagcgtttgcactatactcgttgatatgtaggcatataaagatgagtttggctcccaatcaacaacctgaagacatggaactctctaattacaaactagaaataccatctagccagcagaaaagagcccataaactgaaacaaatgcttgagaatagtcattttgcacgaattatacttttacttctagctataatgggtactgccatggtcataggagatgggattctcactccctccatttcagtcctttctgctgtgagcgggatcagtacatcattgggtcaaaatgctgttgtgggcatcacggtagcaattttggttgtcctattttctttgcaacgatttggtactgataaagtgggagtcttatttgctccagttattttaatatggtttatttttattggtggtattggtctctacaatttattcaaatatgacattggagtattaaaagcttttaatccaaaatatattgttgattactttaaacgaaatggtaaggaaggttggttatcactaggtggagtctttctatgcataacaggatctgaggccatgtttgctgatttgggtcactttagtgtacgagccattcaaattagcttttcttttgttacatttcctgcaatattgacggcatatattgggcaagcagcatatctaagacaatttcctgacaaagtggggaatactttctatgaaagtataccagatcccttgtattggccaacatttgttgtggctattggtgctgccattatagctagtcaggcaatgatttcaggagcattttccattatatcacaagcccttagtttaggttgtttccctagagtcaaggttgttcatacttcagctaaccatgaaggtcaagtttatattccagagatcaactacatgttcttgattggatgtattgtagtttgtgttgccttcaagaccacggaaaatattagccatgcttatgggattgctgttattggtgatatgttgatcacaacaacactagtttcacttataatgcttgttatatggaaaaagagtttatggatggttagccttttcttttttgtatttggtttcatagagattctttatttctcatctcaaataaccaagttttcaaaaggaggatattttccaattgtactagctatgttcttgacaatggttatgggaatttggcattacgttcacaaagaaagatacatgtttgaactcaaaaacaaagtctctaccgagtatttgagggaattggcaaacagaacagatgtacacagagtgcctggaattggacttttgtattccgagcttgtacaaggaattcctccaatatttccgcactttatagctagcgtaccatccattcattcagttgttgtgttcgtttctatcaagacaattccggttaatagagttgctttggaagagaggtttttgtttcggcaagtggaaccaagagagtatagaatatttcgatgtgttgcaagacgcggttacaatgatgtgcttgggaatcctgcggagtttgagtcacaattaatacaaaatctcaaggaatttattcaacaacaggattttatgcttgaggttaatgagggtgctgctacaactacaacaagtgaacaattagtagtatctactgccattaatgaaaatgatcaaatgcaagatatatcaggtaaagaagtgaaaccaaggtcaaataattcttctggtagaattataccaagtcatggtgtatcatcagattccattagatcattgcctgcaagtgtgagaaaatcatcaaatttttacgaacctatcatcatccaaggacctgaagaggaaataaaatttatagataaagcaacagaaaatggtgtggtatatatgataggtgaagcagaggtagtagctcacccaaattcttccattttgaataagattgttgtcaactatgcttatagcttcttgcgcaaaaactttagacaaggagaagattctatagcaattccccgcaagaggcttctcaaggttgggatgacatatgaaatatgaaacaaagtgtgatatatatgttgaccactgtgttatttatgtgtgttatatgctaaatatgtatcttgagttcaattcttcaccaattcttgtaatgtttgaatcttggagaagttaaactcattgctctaacataaataaaaaaagcatattgtgaatta

SEQ ID NO: 148 - DNA, 2635 bp, Medicago sativa; identical to SEQ ID NO: 147

SEQ ID NO: 149 - DNA, 1433 bp, Brassica napus
cggcacgagggtcagtttcaccatcacctcatcatgtggttctcttcccttacatgtcaaagggccacaccatccctctcctccaattcgcccgcctcctcatccgtcaccgccgtgtcatctcctcctccaacgacggcgaagagccatccatgtccatcaccatcttcaccaccccacaaaacaaacctttcatctcaaacttcctctccgacgtcacatcatctatcaaaataatctccctccctttcccggaaaacatcgccggaatccctcccggagtcgaaagcaccgacaagctcccttccatgtcgttatacgtgcctttcacgcgtgcaaccaaatctctccagcctctcttcgaagaaacgctcaagaatcttccgcaagtcacgttcatggtctccgacggattcctgtggtggacactggactccgccgctaagttcgagatcccgagactagccttcttcggcatgaactcgtactcgtcggctctctacaactccgtctccgtacaccaactctttaccaaaccgggaaatattaaatccgataccgaaccggttactgtaccggattttccatggatccgggttaagaagtgcgacttcgtcccggtttgcatcgaaccggatcaatcaggtccagagttcgatttactcatggaccaattaatgtctactgggaagagccgtggggttatagtgaacagcttttacgagctcgagtcaacgttcgttgaccatcgcctaggcgttaggggtgagcccaagccgkggtgtgttgggccattgtgcttggtaaaccctcctaaaccggaaagtgataaaccgatttggattgactggttggaccggaagcgagaggaaagatgtccggttttgtacgtggcctttggaacgcaggctgagatatcgaacgagcagctcagagaaatagccttaggcttggaagattccaaggcaaacttcttgtgggtcacgagaatggacgtggaggatatgattggagtagggttcgagaagagagtgagagagcatgggatgattgttagagattgggtggaccaatgggaaatactgtcccatgaaagtgcgaaaggttttttaagccattgcggatggaactcggcgcaagagagtatatgcgccgggattcccgtgctcgcttggccaatgatggccgagcagccactcaatgccaagttggtcgtggaggagctaaaggtcggagtaagaatcgaaacagaagatggaactctcgaagggttcgtgtcaagagaagaagtcagtcaaaaggttaaagtgttgatggaaggagagatggggaagactgcgagaaagaacgtgaaagagtatgcagaaatggctagagaagcttgggctcaagggacaggttcgtcatggaagaattgagttgcttctgaagag

SEQ ID NO: 150 - DNA, 1596 bp, Brassica napus
gaaacacacgcaaacatgtcagtttcaccatcacctcatcatgtggttctcttcccttacatgtcaaagggccacaccatccctctcctccaattcgcccgcctcctcatccgtcaccgccgtgtcatctcctcctccaacgacggcgaagagccatccatgtccatcaccatcttcaccaccccacaaaacaaacctttcatctcaaacttcctctccgacgtcacatcatctatcaaaataatctccctccctttcccggaaaacatcgccggaatccctcccggagtcgaaagcaccgacaagctcccttccatgtcgttatacgtgcctttcacgcgtgcaaccaaatctctccagcctctcttcgaagaaacgctcaagaatcttccgcaagtcacgttcatggtctccgacggattcctgtggtggacactggactccgccgctaagttcgagatcccgagactagccttcttcggcatgaactcgtactcgtcggctctctacaactccgtctccgtacaccaactctttaccaaaccgggaaatattaaatccgataccgaaccggttactgtaccggattttccatggatccgggttaagaagtgcgacttcgtcccggtttgcatcgaaccggatcaatcaggtccagagttcgatttactcatggaccaattaatgtctactgggaagagccgtggggttatagtgaacagcttttacgagctcgagtcaacgttcgttgaccatcgcctaggcgttaggggtgagcccaagccgtggtgtgttgggccattgtgcttggtaaaccctcctaaaccggaaagtgataaaccgatttggattgactggttggaccggaagcgagaggaaagatgtccggttttgtacgtggcctttggaacgcaggctgagatatcgaacgagcagctcagagaaatagccttaggcttggaagattccaaggcaaacttcttgtgggtcacgagaatggacgtggaagatatgattggagtagggttcgagaagagagtgagagagcatgggatgattgttagagattgggtggaccaatgggaaatactgtcccatgaaagtgtgaaaggttttttaagccattgcggatggaactcggcgcaagagagtatatgcgccgggattcccgtgctcgcttggccaatgatggccgagcagccactcaatgccaagttggtcgtggaggagctaaaggtcggagtaagaatcgaaacagaagatggaactctcgaagggttcgtgtcaagagaagaagtcagtcaaaaggttaaagtgttgatggaaggagagatggggaagactgcgagaaagaacgtgaaagagtatgcagaaatggctagagaagctttggctcaagggacaggttcgtcatggaagaatttgagtttgcttcttgaagagttatgtaagattagagaaacaaatgatgttaataagctgtcaagccatgattagagagcagtgtactcttggttgttgtttcaatctgactaaggtcataaccttactgttcttctgaataaaataaaaaataaaaaagtttgtatgtgttgc

SEQ ID NO: 151 - DNA, 1571 bp, Solanum tuberosum
agatgacagattctacagaagagtcaaagctggaaatagtgatgttcccatggcttgcttttgggcacttgatcccatatatgaatctgtcaaatgaacttgcaaaaagaggtcacaaaatctcattcttgttgccaaaaaatgcagaaattagacttcaaaaactcaatctttatccaaatctcatcaaatttcataaactgacaatacctcatgttgatggccttccatatggagcagagactacagctgatgttcatagatcattggagagtctattagcaacagctatggatgaattgtatgatgaaatcaaatcttttcttcaaaatctaaaaccccatttcgttttctttgattttgcttattggattcctgatttagcacgagaaattgggggtatcaagactctgttttacactgttttttgccctgctgtagcatgtatattgttcattcgatcaccggacaaggctatttttatggcatcaactgcagctgagctagtaaagccaccaccaggttacccttctactactatggtgttgcgcgaatgtgaagctaagttgttgtcatttatatttcatgaatatggcaagggggtgacattttatgaacgagttaagaagggaatgacacgatgtgacgcaatagctatgaaaacatgtagagagattgaaggaaatttttgtgactacatctcaacacaatttgaaaagccagtcctttacacaggacctgttatttctgagccgaaaaaagagcctttagaagaacacggaatatcgaattggcttgagaaattcgagccaagatcagtagtgttctgtgcatttgggagtcaattgattcttgaaaagaaacagtttcaagaacttgttttaggctttgaactgactgagttaccatttcttttagttgttaagccacctcaagggacaaattcagtagaagaagccttgccagagggattcaaacaaagggttcaagaaaagggattgattcttgattgttgggtgccacaattggagattttaagacacaaatcagttggttgtttcgtaactcactgtggttatgggtcgatgtgggagtctttggcactgtgtgattgtcaattggtacttttgccaaggcctattgatcacatttttaatgctaggctgatggaaaaacaacttaaggttggtgtagaagtggagaaagacgaaaatgatttgtttactaaggagaatttgtgcaaggctgtgaaatgtgtgatggataaagatagccaaattggttgtcttgtgaaagagaatcatatgaaatggaaggaacttctttcaagtcctggcttcatgagtaactacattgataacttcattcaagacttgcatgcacttctagttgaaaagacctagataattagcaggggtggatctacgacagacaaaatccaatgtatgtctaatctattcaatcaattgttatcctattttgatattcagaactcataagcttaaaatcgtgtactcgaatgtaacttgcatttatcagatacattcctgcagtgtttaggagttaaaaaa

SEQ ID NO: 152 - DNA, 1571 bp, Solanum tuberosum; identical to SEQ ID NO: 151

SEQ ID NO: 153 - DNA, 1334 bp, Vitis vinifera
aggtcagaccgaaggtttacaaaaaataattgtgatttcattttcatactgtcgrtatcctctctaattctctttttctgccctcgatatctgccctcgttagtccaatttttctagggtttgccggaaaatcctctccaattttcccgagaaaaattatagggcgcgcgcagatatgagctttcaggatctcgaatctgggcgccctttggctcagtcccggcgagattacatcaatgctaagcaagatccgacgcaggccgttgcttctggcattttccagatcaacaccgcggtttcaacttttcagcgactcgttaatacgcttggaacccccaaggacacgtcagagctacgggagaagttgcacaagacgaggctacatattgggcagttagtcaaggatacatctgctaaacttaagcaagctagcgaaacagatcatcatgctgaagttagtgccagcaagaagattgcagatgctaaactggcaaaagattttcaagcagttttaaaagagtttcagaaggctcaacggctggcagcagaaagggaaacggcatatactccttttgttccccagtcagttcttccttccagctatacggcaagtgagatagatgtaggtccagataagagtcctgaacagcgtgctcttcttgtggaatctagaagacaggaggtcttgttgttggacaatgagattgtcttcaatgaggctatcattgaagaaagggagcagggaatacaagaaatccagcaccaaattggcgaggtgaatgagattttcaaagatcttgctgtgctggtccatgagcaaggagttatgattgatgatattggctccaacattgatggtgcccaggctgcaacagcacaggcaaaatcccaacttgcaaaagcatcaaagacccaacgatcaaattcatctctgacctgcttgctgttggtgatatttgggatcatcctcctcattgtgatcatcgtaattgcagcttaatcagaaaattcttagagtccaatcatagagcagacctgtaatctgcttggcaacaaggtgtggtctctttgttaatttctttggttttgatgttttacgagacatgcatgatgagggactgaaacttggcttcaatttcaagggagtatatagtgttggtatctggttataattcagttgtttttatttgaggaggggggtggttgtgagttgtggttgatatctgttctcatcttactgtaagttgctgttttgagggtatatgggtctggttgtgtaatgtttcttttatttttattaataaaaaattataattctttgtgtttcattgcta

SEQ ID NO: 154 - DNA, 1334 bp, Vitis vinifera
aggtcaggccgaaggtttacaaaaaataattgtgatttcattttcatactgtcgatatcctctctaattctctttttctgccctcgatatctgccctcgttagtccaatttttctagggtttgccggaaaatcctctccaattttcccgagaaaaattctagggcgcgcgcagatatgagctttcaggatctcgaatctgggcgccctttggctcagtcccggcgagattacatcaatgctaagcaagatccgacgcaggccgttgcttctggcattttccagatcaataccgcggtttcaacttttcagcgactcgttaatacgcttggaacccccaaggacacgtcagagctacgggagaagttgcacaagacgaggctacatattgggcagttagtcaaggatacctctgctaaacttaagcaagctagcgaaacagatcatcatgctgaagttagtgccagcaagaagattgcagatgctaaactggcaaaagattttcaagcagttttaaaagagtttcagaaggctcaacggctggcagcagaaagggaaacggcatatactccttttgttccccagtcagttcttccttccagctatacggcaagtgagatagatgtaggtccagataagagtcctgaacagcgtgctcttcttgtggaatctagaagacaggaggtcttgttgttggacaatgagattgtcttcaatgaggctatcattgaagaaagggagcagggaatacaagaaatccagcaccaaattggcgaggtgaatgagattttcaaagatcttgctgtgctggtccatgagcaaggagttatgattgatgatattggctccaacattgatggtgcccaggctgcaacagcacaggcaaaatcccaacttgcaaaagcatcaaagacccaacgatcaaattcatctctgacctgcttgctgttggtgatatttgggatcatcctcctcattgtgatcatcgtaattgcagcttaatcagaaaattcttagagtccaatcatagagcagacctgtaatctgcttggcaacaaggtgtggtctctttgttaatttctttggttttgatgttttacgagacatgcatgatgagggactgaaacttggcttcaatttcaagggagtatatagtgttggtatctggttataattcagttgtttttatttgaggaggggggtggttgtgagttgtggttgatatctgttctcatcttactgtaagttgctgttttgagggtatatgggtctggttgtgtaatgtttcttttatttttattaataaaaaattataattctttgtgtttcattgcta

SEQ ID NO: 155 - DNA, 2301 bp, Saccharum officinarum
gcgaggactcctcaaaagaaccactccctccctcctccgcgtactctccctcgtgagctcgtcgctggctcgctcgctctctctcctattcactcctccccgcgctagctaccagcagcctctcgcttaaagagggaggaggggggcgaggagcaatgtcggagcagcagccattgccgcagcctcggagcagcatgcgggaggcgctggagaaggaggacaaggagaaggcggtggccgccgcggccaaggagaaggcaaccgttcccaagaacggcggcaacggcgggggcggcaagaatggcggcgggggtaacggcggaggcgccccgccgtccggggaggagacggcccgggagattcaggtggtgagggaggcgtaccggcgcgagacggccgcgccggcgtacgtcatccccgaggagccgccggccatggtggagctcgtgggctggtacatctacggcttctgctcctacttcatcacccacctgctgctgccggtgctcttcccggtcatcgtcacgcagatcgcctaccccaactccgatttcacgccggaccccaagtacaccctcaagggcgccacctgctccgtccatgagatgtccatgtaccaaaggcttaccaagcactccattgtgattgatggatcccggatgtcacctttgggctggagtggtctatcatgggcaattggcatcctcatcgtggcgccgctcctcactcagactgctcaccatctcgaccgtggccagtatcaatcgctaatcctcattgctgccacgtcctttgggtcgttcttctgcctgctcacaggtttcttcaagacggtctgggtgttcctattctacatcatcttcattgcaggctcaatcattgtcgccgaggcagtgcatacccgcaaccttggtctgatgatccgtggccttgctgcgcatgactcaggcaagcaccttgttcttcgccgccgtgctgctgcgagccagctcagcctgtactgcactgccattggaggcattggagcggccctcatggctgcattcatgtaccacatgctgcggcgcactgatcagctcactggcctttgggttgtctccatcttctgtggccttatctggttcattggcatttgccatggtctcttcacaaacaggcccagcagctcatcacccaccactgcatttgagcccaacttcttcaccaagctcagctacagcatgacccttctgcgttacccgcaggccattggcagcttggttgcagtgttcctgtcctctttcgccacaatgtgcatcttcaccagcggcacactctatgctatcggtggtgtttgcatcaagccagtgcttgtgcttgtgctatggatcctttacttcctgttccccttgatctcacttccacttctccacccaatccagatcataatccgtgctgatgctgttcgcatgcagctgcttgggttcataatctgcctattcgtgtctggtgctgggttctacttcaagagccacaggtggagagctgcccacatcattgttattgcccttgtccagagcactgccaatggcatattgtacgcatttggccgcattctgctcctcgatgcctcaccaccggggaaggagggtgcattctcggtctggtatgcatttgtccgtgttactggtgccatgattggctttgctgcttcctctgctggccctgggcgtgccggaggatcattcgccgctgcattccttgggagcttcctgggcatcattgtgctgatctttggcaatgtcagcaacattggggcgctgaaggctgctgggcacctcaagggaatggacgatgagaaaaggatggagaaaggcgaaggcatgggtggcgccgtcgctgattcaggcgaaagcagggggagggtatgatgacaattcgtgaaggtgtatttctgggaggggaaaaaagattgcattctgtggaggttgtgtttgtgagaaggatttgttctcttctttcttgtttcttggtcatgtttcagtgagacagttaatctcagtgctttgcccgtttgatgcatgatgatggatgacatagtggtagaggagtgtgctagttgttaatatgttattcttttgcttgcaagacaattgtaactgatgatcatatggttctttgttcttcacccgcccaaaatctctaggcagtcaagcttcattcataattcaatttctgttgaaaaagatgtgattgtgacattgtgtagagagaaataaaccgctgtaaactctgttgttgcgatcatattcattccctttg

SEQ ID NO: 156 - DNA, 2301 bp, Saccharum officinarum; identical to SEQ ID NO: 155

SEQ ID NO: 157 - DNA, 1452 bp, Saccharum officinarum
tggtaggaaagctcgtcgccgtacggggctcggctcaggtgagcgaggcgagcggcgggtactgaggccggaggcgatgggccgcctccgcgacgggcgagccttcctccaccgcgcgctggtcctctcgtcgctgctcctcctcgcctccggcgaaatcttcttcgaggagcggttcgatgatgggtgggatagccgttgggtgaaatctgattggaagaagagccaaggacaagccggaaccttccgacacacagcgggaacctattctggagaccctgacgataaaggtatacaaacaactggggatgccaaacattttgctatatcagcaaaattcccagaatttagtaacaagggccggacattggtgatccagtactctctaaagattgagcaagacattgaatgtggtggtgcttacatcaaacttatgtctggttatctcaaccagaagaaatttggcggcgacactccttacagcttcatgtttgggcctgatatatgtggggatcagaaaaagaagctccatctcatactttcataccaagggcaaaactaccctatcaagaaagatctaaaatgcgaagcagacaagttgacacatttttacacatttattctaagacctgatgccacttatagcatccttatcgataaccgggagagagaatttggaagcatgtacactgattgggatatccttcctcctcgtaagatcaaagatgttaatgcaaaaaagccaaaagactgggatgacagggaatatattgaagatcctgatcaagttaagccagagggatatgattcaattcctaaacagatacctgatccaaaggacaaaaagcctgagtcatgggatgatgacgaagacggtacatggaagcccagaatgatacctaatccagaatacaagggaccatggaagcggaagaaaattaagaatcctaactacaaaggaaaatggaagaccccatggattgacaatccagagtttgaggatgacccagacctatatgttctgaaacctttgcagtatgtggggattgaagtctggcaggtcaaagctggttccgtttttgacaacattttgatttgcgatgatccagactatgcaagacatgttgtagatgaaacttttgctgcaaataaggaggctgaaaaagaggcctttgaaggagctgaaaagaagaggaaggctagagaagaagaggaagcacggcgagcacgggaggaaggggaaagaacaaagcggggaaaaggttaaggggcccgggggggcccccttccccgggtattattttaagggttttacctttcccttcccggggggggttttaacccccgttttttaaaaacccaaatttggttttttaccccccttttttgaaaaaggcccctggccaattttgtttccctttcccgggggaccccaaatttttttccccaaac

SEQ ID NO: 158 - DNA, 1732 bp, Saccharum officinarum
  misc_feature (1727)..(1727): n is a, c, g, or t
tggtaggaaagctcgtcgccgtacggggctcggctcaggtgagcgaggcgagcggcgggtactgaggccggaggcgatgggccgcctccgcgacgggcgagccttcctccaccgcgcgctggtcctctcgtcgctgctcctcctcgcctccggcgaaatcttcttcgaggagcggttcgatgatgggtgggatagccgttgggtgaaatctgattggaagaagagccaaggacaagccggaaccttccgacacacagcgggaacctattctggagaccctgacgataaaggtatacaaacaactggggatgccaaacattttgctatatcagcaaaattcccagaatttagtaacaagggccggacattggtgatccagtactctctaaagattgagcaagacattgaatgtggtggtgcttacatcaaacttatgtctggttatctcaaccagaagaaatttggcggcgacactccttacagcttcatgtttgggcctgatatatgtggggatcagaaaaagaagctccatctcatactttcataccaagggcaaaactaccctatcaagaaagatctaaaatgcgaagcagacaagttgacacatttttacacatttattctaagacctgatgccacttatagcatccttatcgataaccgggagagagaatttggaagcatgtacactgattgggatatccttcctcctcgtaagatcaaagatgttaatgcaaaaaagccaaaagactgggatgacagggaatatattgaagatcctgatcaagttaagccagagggatatgattcaattcctaaacagatacctgatccaaaggacaaaaagcctgagtcatgggatgatgacgaagacggtacatggaagcccagaatgatacctaatccagaatacaagggaccatggaagcggaagaaaattaagaatcctaactacaaaggaaaatggaagaccccatggattgacaatccagagtttgaggatgacccagacctatatgttctgaaacctttgcagtatgtggggattgaagtctggcaggtcaaagctggttccgtttttgacaacattttgatttgcgatgatccagactatgcaagacatgttgtagatgaaacttttgctgcaaataaggaggctgaaaaagaggcctttgaaggagctgaaaagaagaggaaggctagagaagaagaggaagcacggcgagcacgggaggaaggggaaagacgaaggcgggagagggatagggaccgtggcagggaccgttacagggatagatataaggacgagctatagatcacctgttcttttgaaatctgcacgatattggttgtctatggaactgggccttgatgattgtgtcaataaggtgtaccacttcagggcgggcacagatgtttgaagtccttaaccgtactgttacagtcgtggagagcacacgtgcagaacttgtatgttgtacacgggaatcaagctgaatctgtgattttggcgatgggtagagaatgaccatcgcggctgtaactaaacttccccgttgcgaacttgcgatgcaatatgagctgtagtactgtccttgtactaatatttacctcgaaatgtataatcgtgctgcaaacgttgataaacctttcattgtcaggagtcaggacaaggaaaaacacgaagggcctgattgagcacgcctttgttgtctgcttcctatcanaataa

SEQ ID NO: 159 - DNA, 1756 bp, Saccharum officinarum
  misc_feature (1751)..(1751): n is a, c, g, or t
tggtaggaaagctcgtcgccgtacggggctcggctcaggtgagcgaggcgagcggcgggtactgaggccggaggcgatgggccgcctccgcgacgggcgagccttcctccaccgcgcgctggtcctctcgtcgctgctcctcctcgcctccggcgaaatcttcttcgaggagcggttcgatgatgggtgggatagccgttgggtgaaatctgattggaagaagagccaaggacaagccggaaccttccgacacacagcgggaacctattctggagaccctgacgataaaggtatacaaacaactggggatgccaaacattttgctatatcagcaaaattcccagaatttagtaacaagggccggacattggtgatccagtactctctaaagattgagcaagacattgaatgtggtggtgcttacatcaaacttatgtctggttatctcaaccagaagaaatttggcggcgacactccttacagcttcatgtttgggcctgatatatgtggggatcagaaaaagaagctccatctcatactttcataccaagggcaaaactaccctatcaagaaagatctaaaatgcgaagcagacaagttgacacatttttacacatttattctaagacctgatgccacttatagcatccttatcgataaccgggagagagaatttggaagcatgtacactgattgggatatccttcctcctcgtaagatcaaagatgttaatgcaaaaaagccaaaagactgggatgacagggaatatattgaagatcctgatcaagttaagccagagggatatgattcaattcctaaacagatacctgatccaaaggacaaaaagcctgagtcatgggatgatgacgaagacggtacatggaagcccagaatgatacctaatccagaatacaagggaccatggaagcggaagaaaattaagaatcctaactacaaaggaaaatggaagaccccatggattgacaatccagagtttgaggatgacccagacctatatgttctgaaacctttgcagtatgtggggattgaagtctggcaggtcaaagctggttccgtttttgacaacattttgatttgcgatgatccagactatgcaagacatgttgtagatgaaacttttgctgcaaataaggaggctgaaaaagaggcctttgaaggagctgaaaagaagaggaaggctagagaagaagaggaagcacggcgagcacgggaggaaggggaaagacgaaggcgggagagggatagggaccgtggcagggaccgttacagggatagatataagcgtcatagacactacgactaccatgacgagctatagatcacctgttcttttgaaatctgcacgatattggttgtctatggaactgggccttgatgattgtgtcaataaggtgtaccacttcagggcgggcacagatgtttgaagtccttaaccgtactgttacagtcgtggagagcacacgtgcagaacttgtatgttgtacacgggaatcaagctgaatctgtgattttggcgatgggtagagaatgaccatcgcggctgtaactaaacttccccgttgcgaacttgcgatgcaatatgagctgtagtactgtccttgtactaatatttacctcgaaatgtataatcgtgctgcaaacgttgataaacctttcattgtcaggagtcaggacaaggaaaaacacgaagggcctgattgagcacgcctttgttgtctgcttcctatcanaataa

SEQ ID NO: 160 - DNA, 1756 bp, Saccharum officinarum; identical to SEQ ID NO: 159
  misc_feature (1751)..(1751): n is a, c, g, or t

SEQ ID NO: 161 - DNA, 3446 bp, Sorghum bicolor
ggcacgaggagaaaaggttaagcctcttggcgaaggcacagaaccgtctggccaagctggatgaactccgacaagctgctaagaatgatgtggaaatgcggtttgagaaggaaagggaagaacttgagaccagagttgagtctcgtgtccgacaggcagaggagaaccgcatgcgccttctgcatgccgatatgcagaagcgggctgcactgaaggagaggacagcgaggtccctggtgcagaaggcaacatcagagagcaaatacatggagcaggtgcggtctgcaatttcacaaaagagagctgctgctgagaagaagcgactgaggttgctggaagctgaaaagacaaaggctcaggctaggcttttgcgcatccaaaaggctgccatgactgtatgcagccagagagaatcggagaggagaaaactgaaagaacagctggataacaaacttcaaagggcgaagaggcagagggctgagtatttgaagcagagaggaagtcctcgtggttcaacccacgctgattacataaagcatgcagatgccctctcaagaaaactagcaagaaactggagaatatttgtgaagtccaggaagacaacatttgctttggttcaagcttatgatgccttggggattaatgagaagtctgtgaaaagtatgccttttgaaaaattagccatgtcaatggaatctcctatggttcttcagagcacaaaggcattacttgaccgattggagaaacgccttgtcatttctcagtcagtagcatcttcatcagtagaraatgttgatcatctactgaaacgccttggttctcccccaaggaggaaggctcctcttagcagagaaggaaaaactcgggcagtggtaaaaagatcagctaaaagttctgaagcaaacagcagattgcccaggtactcactgagggtcgtgctctgcgcttacatgatactggctcatcccagtgctgttttaagtgggcaaggcgagcgggagagacaacttatcgagtcagcagcaaactttatcaaggagttcgaactgttgattaagacaatacttgatggaccagggcagtcatctgatgttactggccagaggaagttcagaattcagttggctaattttgacaaggcgtggtgcacgtatctttaccgctttgtggtgtggaaggtaaaagatgcaagattattggaggaagatcttgtcagggctgcatgcaagcttgagctgtcaatgatgcaaacatgcaagctaactgcagatgggcactcgccaaacaatcttactcatgacatgaaggcaattcagaaacaggttactgatgatcagaagcttttacgtgagaaggttcagcacctgagtggtgatgctggccttgagaggatggactctgctcttttggatacgagatcaaagttctttgaagcaaaagagaatgggagtccattggcagcacctgttgcaaatgtatctacccctttgagcattaattcatctgtgaaggtcccactttctgaggttaatgaaagttccaggacaaatgctgttggaacaagctctgttgtacgttctctatttggtgcttcatcatcagtcggttcatcaccagcaaagcagccgacagagaatgaacaaatggtcaatgagatgcttcatgaggatgccagtgcttttgctggcaggtctgatagtgctagtactgtggaggaggagttccagaagaaagtgagagaaaccatggagaaagctttctgggatatggtcaccaactccatgagaggagaaagacctgattatagtcaattgatcaacctagtaaaggaagtgagagattcgttgcatgacctggctccaaaagaatggaaggagaaaattcttgagaacattgaccttgaaattctgtctcaggtacttgggtcaggttcccaggatgcacaatacctggggcagattttgcagtattctctggatatggttcgccagctctctgctgctgcaaaggaggatgagatgaagaaaaatcatgataaattattgagtgagttgtctacaaattctgaagttaatgacaatggcatcaactcatttgccattgctgttatcaagggcmtgcgtttcatcctggaagaaataaaggaactgcaagcagaagtgagtaaagcacgtgtccagatgatgcaacagatcataaaagaatcggctggggtggagtacctgcagaaggctttcgctgatcgctatggaccccctgagaatgcatcagcttctcttcccctaactctgcaatggattatgacatcaaataacattgtggaagtagaatggagtgaacattcagactgtctttcaataatgcaatcagcaggacaggctcctgctcttgttccggtacttcgagctggtcatggaactctagtagggcaaccatcttcttctgcagcagacacctctgttcaaccagagtgcaagggtgagaagcttgacaagctgataaggattggcctgctgcaacttattagtagtatggagggcttgcaattgcagtcaattcctgaaagttttcagattaatctcctgaggctgagggctgtgcagagccaattccaacaggtgatcgtgattgccacaagcatgctcgtcctgcgccaagttctgatgagtgagaactcgaaggccactcctctggaactggaaaacgctatctcagaactcttcaaggctctcgtgaacatactggacaactcacctgatgccggcacggaagagattgtgcaggcgatggtcaatgcatcagcctcagttggctcaccatcagaggagaaggttcaggccaggatgcagatgatcaccagggtgttcctcaagagtctccagcctggtgacgtggtcttcaagaaggtctcccgcgctgtctactgtgccttccgtggcatcatcttaggtggcagtggtcccaagggccagaagctggcggacgcggctttgcgccgcattggcgcggccaaggttatggacagggtgttgaaggctgctgaggtgctgatcaagatggcaacggtatcagagaaggtccacggcccgtggtacaaagctctggtgtgaatgtgaatggtttggcttttgtgaatatgaatataactacagaaggtcaaagtgtaaattccttgttccactgggtggggtgggagatatatggcattgtacagcaatttatagttgttgaattgatccgtaggcagttcaggatgtgaagaattctggtgagctgggcgaatatggatgctctttcaccagaatttagtcaggcaagaaggatggatgctaaaacgcatctggaaatgtaaattgtggcaccttgtttgattttagaactgaaataatgtaaataattgcttgtaagtcatttgtgctctgcacatatcgctacatttggttgaa

SEQ ID NO: 162 - DNA, 3759 bp, Sorghum bicolor
ttgatgatgggggcgcgggaaccggtggccatggagataccagcggaggaaggactggcggcggcggcgagggcgccgccgcggcggattaggaggaggctggtggagggggcgcgcggcgccggggccccggcgagcgtggaggagatcgaggccaggctcagggaggccgagctccggaggcagcaattccatgaatggttggcctgcaaagcaaggaagaagccacggagtccatcgtggtcctctcaagaggaagaccacgggcagcgccttgaagcaaaacttctggctgctgagcagaaaaggttaagcctcttggcgaaggcacagaaccgtctggccaagctggatgaactccgacaagctgctaagaatgatgtggaaatgcggtttgagaaggaaagggaagaacttgagaccagagttgagtctcgtgtccgacaggcagaggagaaccgcatgcgccttctgcatgccgatatgcagaagcgggctgcactgaaggagaggacagcgaggtccctggtgcagaaggcaacatcagagagcaaatacatggagcaggtgcggtctgcaatttcacaaaagagagctgctgctgagaagaagcgactgaggttgctggaagctgaaaagacaaaggctcaggctaggcttttgcgcatccaaaaggctgccatgactgtatgcagccagagagaatcggagaggagaaaactgaaagaacagctggataacaaacttcaaagggcgaagaggcagagggctgagtatttgaagcagagaggaagtcctcgtggttcaacccacgctgattacataaagcatgcagatgccctctcaagaaaactagcaagaaactggagaatatttgtgaagtccaggaagacaacatttgctttggttcaagcttatgatgccttggggattaatgagaagtctgtgaaaagtatgccttttgaaaaattagccatgtcaatggaatctcctatggttcttcagagcacaaaggcattacttgaccgattggagaaacgccttgtcatttctcagtcagtagcatcttcatcagtagaaaatgttgatcatctactgaaacgccttggttctcccccaaggaggaaggctcctcttagcagagaaggaaaaactcgggcagtggtaaaaagatcagctaaaagttctgaagcaaacagcagattgcccaggtactcactgagggtcgtgctctgcgcttacatgatactggctcatcccagtgctgttttaagtgggcaaggcgagcgggagagacaacttatcgagtcagcagcaaactttatcaaggagttcgaactgttgattaagacaatacttgatggaccagggcagtcatctgatgttactggccagaggaagttcagaattcagttggctaattttgacaaggcgtggtgcacgtatctttaccgctttgtggtgtggaaggtaaaagatgcaagattattggaggaagatcttgtcagggctgcatgcaagcttgagctgtcaatgatgcaaacatgcaagctaactgcagatgggcactcgccaaacaatcttactcatgacatgaaggcaattcagaaacaggttactgatgatcagaagcttttacgtgagaaggttcagcacctgagtggtgatgctggccttgagaggatggactctgctcttttggatacgagatcaaagttctttgaagcaaaagagaatgggagtccattggcagcacctgttgcaaatgtatctacccctttgagcattaattcatctgtgaaggtcccactttctgaggttaatgaaagttccaggacaaatgctgttggaacaagctctgttgtacgttctctatttggtgcttcatcatcagtcggttcatcaccagcaaagcagccgacagagaatgaacaaatggtcaatgagatgcttcatgaggatgccagtgcttttgctggcaggtctgatagtgctagtactgtggaggaggagttccagaagaaagtgagagaaaccatggagaaagctttctgggatatggtcaccaactccatgagaggagaaagacctgattatagtcaattgatcaacctagtaaaggaagtgagagattcgttgcatgacctggctccaaaagaatggaaggagaaaattcttgagaacattgaccttgaaattctgtctcaggtacttgggtcaggttcccaggatgcacaatacctggggcagattttgcagtattctctggatatggttcgccagctctctgctgctgcaaaggaggatgagatgaagaaaaatcatgataaattattgagtgagttgtctacaaattctgaagttaatgacaatggcatcaactcatttgccattgctgttatcaagggcctgcgtttcatcctggaagaaataaaggaactgcaagcagaagtgagtaaagcacgtgtccagatgatgcaacagatcataaaagaatcggctggggtggagtacctgcagaaggctttcgctgatcgctatggaccccctgagaatgcatcagcttctcttcccctaactctgcaatggattatgacatcaaataacattgtggaagtagaatggagtgaacattcagactgtctttcaataatgcaatcagcaggacaggctcctgctcttgttccggtacttcgagctggtcatggaactctagtagggcaaccatcttcttctgcagcagacacctctgttcaaccagagtgcaagggtgagaagcttgacaagctgataaggattggcctgctgcaacttattagtagtatggagggcttgcaattgcagtcaattcctgaaagttttcagattaatctcctgaggctgagggctgtgcagagccaattccaacaggtgatcgtgattgccacaagcatgctcgtcctgcgccaagttctgatgagtgagaactcgaaggccactcctctggaactggaaaacgctatctcagaactcttcaaggctctcgtgaacatactggacaactcacctgatgccggcacggaagagattgtgcaggcgatggtcaatgcatcagcctcagttggctcaccatcagaggagaaggttcaggccaggatgcagatgatcaccagggtgttcctcaagagtctccagcctggtgacgtggtcttcaagaaggtctcccgcgctgtctactgtgccttccgtggcatcatcttaggtggcagtggtcccaagggccagaagctggcggacgcggctttgcgccgcattggcgcggccaaggttatggacagggtgttgaaggctgctgaggtgctgatcaagatggcaacggtatcagagaaggtccacggcccgtggtacaaagctctggtgtgaatgtgaatggtttggcttttgtgaatatgaatataactacagaaggtcaaagtgtaaattccttgttccactgggtggggtgggagatatatggcattgtacagcaatttatagttgttgaattgatccgtaggcagttcaggatgtgaagaattctggtgagctgggcgaatatggatgctctttcaccagaatttagtcaggcaagaaggatggatgctaaaacgcatctggaaatgtaaattgtggcaccttgtttgattttagaactgaaataatgtaaataattgcttgtaagtcatttgtgctctgcacatatcgctacatttggttgaagtagaactttaccgttctctt

SEQ ID NO: 163 - DNA, 2808 bp, Nicotiana tabacum
tcattggatttcttgaatttcagttgagacttggatggtcagcatctctaattgagccttcctagactaaaccctatatatatggctgtgattggttattttgatgtctagaaatgttgggggtagatgagaaggacagggtacctggtgggaatcggaaaacgtatgcacggtctgtttcctggtctgataggtccccgactaagtccagtgccaaaccacaatggaatagtaaagcaagggcttgtttgccaccccttcagcctctttctattaccagaccaactgctgaggagtggccttgtgctgggtcggatgatcttggcgtatggcctaataatccccctactccaggtgttaggcttggaccagtcagcacccatgtaggttcagctactaagcgggttccgcgagaatttgaattcaagaaagacaagcttgctttcttcaataaggaatgctctaagattgtggatcacatttatttaggaagtgacaccgtggcaaagaatcgtgatattctccatgagaatggaatcactcatgtcttaaactgtgtagggtttagttgtcccgaatactttaaggatgatctcgtgtacaagacactctggctgcaggatagtccaactgaggatataacgagtattctctatgatgtctttgattattttgaagatgttcgtgaacaaggtgggagagtttttgtgcactgctaccaaggagtgtcccgatcaacctctttggttattgcatatcttatgtggaaagaggggttgagctttgaagatgcattccagcatgtaaaagctgcaagaggagtgacaaacccgaatatgggttttgcttgccaactattgcagtgccagaaacgagtgcatgctctacctgtgagtccgagttctgtgcttagaatgtacaggatggcacctcactccccatatgatccccttcatttggtaccaaaaatgctgaatgaggcaggggctgaaggatttgattctcgcggagccttccttgttcttattccttctgctatatacgtgtggattgggaagcattgtgactctgtaatgtcagataacgccagggccgcagcctttcaggtaatccgctatgaaaaggctcaaggtcctgttataattatcaatgaaggcaaagagccttctgatttttggagtgctcttagccatgggagcttcttcactggtggttgcagcaaagaaaagaccaaggtcgaagcaagtttgttagatggaactactggcacgattactgataatatcatccagtatattggtcaacagaaggttggtgaatatgaccttgattttgaaattttctacaaagcacttgctggtggggttgttccaccttttccattatcaggtactgaatctgagatgcgtcttcctgcaagagagaatggatggagtagattgaggcgaaagttttccagtggaataatgaaagaatttatcacagcctccaaattgtacagtcatactggtggccaagcgagtcctgtactcgataaaatggacacaagtaaagaaatctctcctgctttgccttcatcaccttcaagtcctcagtgtgattcaccagattccttttcttcttatgcaaccagcagtccaagttttagagatgttgggaactctggtcttgactctgagcctttgctatcgccatcaccttcatttagctcacttgattctctctcttgttttcttgttaataaaccaaagtctgataccacatccccctcactctcaccttcaacctcagattactccagttctttcaccttttctccctcatcttctaattggtccgacttggcatacctatctgcacagccttcacctacaagatttgaatacgaagatcctaactttgtgaagaatgattccttcaaagaaagttcatctttactttgtaaagaaacgtcccttccagcagaggaagcatttccaacctgtcatactcttggacaggcaaacagttgtttactgtacaaagaagctttcccctcactagccgagcgcagaggcagtcatcctcctcctaggatgatgttacgttgcaatgatgattccactcaaatttcagcaaagttggtgagaacatcctcattttctctccctagctttggagacgatacaataaagtgtctggagtgtgacaaccttaatgacggagattttgccgatactagtaaagaggagttaatgttggatgctgagagttcgattactgacaatcaactcccaaatggagttcaacctgacgatgtatctcgcagtttctatgaccatccaattgtagttgcagatacaactgatttaggtctttaccaatggccttctatgcataaattaggattggcttctgggttttttgattcgaggtccgtctatatcatagtcattcctgacttgaatttagatgaaaatagttccaatagtttgtacatttgggtagggcgtgatgtgcaatggaaggaaagtccaaatcaagtgatcaacaatgaatccatgtgtgaggatggtcatgttcattgggagaaagttggacgccgttttcttattcagaagggcctggctactagctctcttgttcagatagtgaaagaaggtgaggaacctgagcagcttcttaaacatctgccttgtttctcacttgagaagacatattagatgtagtagggatagaacaccgttgtcgatcggttgcttcttcaatccttctggttagtgtgagcatcccaggcagtgaaagttgaaggtttctgcttgtgtgatg

SEQ ID NO: 164 - DNA, 2808 bp, Nicotiana tabacum; identical to SEQ ID NO: 163

SEQ ID NO: 165 - DNA, 853 bp, Saccharum officinarum
gagaacaagtaggtcaaggttcttgcggaacagtgtatcatgctcagtggtatggctcggatgtagcagttaaactgttctctaagcaggaatactcagaagaaatgatagataccttcagacaagaggtatcactgatgaagaaactacgccatccaaatattatactcttcatgggtgcagttgcatctccagaacgactttgtattgttacagaatttcttccacgggggagtttgttccgcttacttcaaaagaacactggcaagctggatccgagacggcgagtttacatggctatagacattgcaaggggtatgaattatcttcaccattgtagccctcctattgttcaccgtgatttaaaatcatcaaatttgttggttgacaagaactggactgtaaaggttgcagattttggtctttcacgtctaaaactcgaaacgtttttgcgaacaaaaactgggaaaggaacgccacaatggatggccccagaggtgttacgtaatgaaccttcagatgaaaagtctgatgtgtacagctatggggttattctgtgggaacttgtgacccagaagataccctgggataatctcaatacaatgcaggttatcggagccgttggttttatggatcagaggttggacatcccaagcgatacagatcctaaatgggcgtcgatgattgagagttgttgggatagcgacccacgaaaacgcccatcattcctagagctcctggacagscttagagacctgcaaaagcagtacagcctgcaggctcaratgcagcggaacctgtctgccgatgttctgctgaaaggggctgtgaaatgagcactgaggaatggtag

SEQ ID NO: 166 - DNA, 1011 bp, Saccharum officinarum
gagaacaagtaggtcaaggttcttgcggaacagtgtatcatgctcagtggtatggctcggatgtagcagttaaactgttctctaagcaggaatactcagaagaaatgatagataccttcagacaagaggtatcactgatgaagaaactacgccatccaaatattatactcttcatgggtgcagttgcatctccagaacgactttgtattgttacagaatttcttccacgggggagtttgttccgcttacttcaaaagaacactggcaagctggatccgagacggcgagtttacatggctatagacattgcaaggggtatgaattatcttcaccattgtagccctcctattgttcaccgtgatttaaaatcatcaaatttgttggttgacaagaactggactgtaaaggttgcagattttggtctttcacgtctaaaactcgaaacgtttttgcgaacaaaaactgggaaaggaacgccacaatggatggccccagaggtgttacgtaatgaaccttcagatgaaaagtctgatgtgtacagctatggggttattctgtgggaacttgtgacccagaagataccctgggataatctcaatacaatgcaggttatcggagccgttggttttatggatcagaggttggacatcccaagcgatacagatcctaaatgggcgtcgatgattgagagttgttgggataggtaagcatattgctttttcctactaagcaacagttaactagtcgaatgcatatgtagagttcatgtttgaagaagcccaaatcatctttgagaaaatcatagtttcattctgatgaacagtgtgattagtccatgatacatgtatccttacttagcagcgacccacgaaaacgcccatcattcctagagctcctggacagscttagagacctgcaaaagcagtacagcctgcaggctcaratgcagcggaacctgtctgccgatgttctgctgaaaggggctgtgaaatgagcactgaggaatggtag

SEQ ID NO: 167 - DNA, 1011 bp, Saccharum officinarum; identical to SEQ ID NO: 166

SEQ ID NO: 168 - DNA, 2283 bp, Gossypium hirsutum
ctaggttgcttttgcctttactttttatttttattcttttggattttactcatttgattagcagtgtttatgaatgagtagcttatatatgtatatgttaactcccccgggctgtttcataatttcattttattattgaagtggcgcatggtgggttctttggctgttgttgttgttgttgtcgtctaggtgtttgttaaatgaacctaatcgtttcccaccatcgataccgcttagcttttggggtgtttttgttgttggagttagtagtagtaatgtcacagaaaaggccccaggaggatggtaaggctcgaccgtctgaagggaacagtcctgatcaagataaacggagaagggttccaaccttgagaaatgtggttcaggaggtgatgaagttgcagtctgtccaacatttgctggagccagttttggagccattgattcgtagggtggtcaaagaagaagttgaattggctcttagaaagcatttgaataatatgaaaaggaatggtgggaaggaggtaaattcttccgagtcaagaagcttacaactccaattcttaaataatctctcccttcctgtgttcactggagcacgaattgaggcagaagattgttctaccataaaagtggctatagttgatgctcttactggacaaatagttacctctggtccggagtcttctgccaaaatagaagttgtagtccttgagggagattttgatggtgatgaggaggacaactgggcggttgaagagtttaacaataacattgtaaaagagagagaaggaaagaaacctcttcttaccggagattcatttctaactctcaccgagggcataggtttagtgggtgagatttcatttacagataattcaagctggactagatgccgtcgtttcagacttggtgctagagttgtggatggctctggtggaactagagtaagagaagcaaagacagaatccttcattgtcagggatcaccgtggagaattatacaagaagcatcatcctccatctctttctgatgaagtatggagattagagaaaattggcaaagatggggctttccataagcgcttgagtcgggaaaatatcaacactgttaaggatttcttgaccatgctctgtataaatcctccaaggcttcgacatatccttggcactggtatgtctgctaagatgtgggaaatcactgtggagcatgctcgaacatgtgtgcttgataagaggaggcacgtgtattgccctcctggttctcaacagaaatctggtgtgatcttcaacgtcgtgggacaattgacaggactactttcagaatgccagtaccttacaactgataagctatcagaaactgagaagattgaagctcaaaacttggtaatttctgcatttgaacattgggcagaagtcatctcgtttgacgacgaagcctctctcataagtagttgttcaaaattagctaagattccttgcacaaactctgccaagacagagaattctaatggtagcaaggttttggcttctcaaaagatggatggatatgattatgctcaaacaagtgcttcttctcccgatatcatctcaaccatctattcagtttggggtatgggtggattggaggattatgccctgcatggtatcgaaaacccggatcttagatatgatcaaacattgagttatcctggccaagtcaataattccctaacgtgtgacgcagatatttctcagacttttggtgacgaggatcatcttggatattttgatggtgatcttcattcccagggccttggtttggagtcacaagcggatctacaaactgctgttgacggattccttgtgcaacgtaaagttgctgaccaagcgaagagtagatggaccaaggtttttagtgtactgaagtggttctctatcaaaagaaaagttaaagaaaaatttctaggtctgagatatggcactggactttaatacttttacaggtgcagtcggaaatagtaggggggagccaagtgctgccttattgaattttggttggttatagaattgaagaggttgaagtatcctaggttcacaccatacagctgcttgtttacaaatccttggtggaggtcagaaatgcagtactctgtatcatattacactgtaaatattatattgatgagcaacacagaatttcgcagatttttagttgtaaattatcactgttgcttcagtggaagcatggaccatgcatgaatgaaatgcttttgtttgataactgcaaatttattgcattttttgt

SEQ ID NO: 169 - DNA, 960 bp, Brassica napus
gactgctttttaacacaatayagagaasacastagtgtgacaggcaagagacttctgaaccaaatctaaagagctcaacacacagcaaaagagaactaggtaaagagctgttgagttgtttctttggtgtgtagatggaaacagagaaaaagaacagcaaggagctagggcttaaccacctagggttcgtgagagttgcagcgatccaggttcttgttagcctctcaaacctctacgactacgccaaacaaaactccggtcctcttaaaccggccgtgggaaaggtggaaggagccgtcaccaccgtcgtcacccctgtctwcaacaaattcaaagatgttccagatactttcctcctctttcttgatcacaaggtaggtgaagtttcgaacaagtttgataagcatgctcctccactggctaagcaagtagtaagccaagcacatgtactgatccaggcgactacagagaaggctcaaagctttgtgaaagaggctcgtaccggtggtcctaaagctgcctttaactatgctgcaactgagtacaagtacttsgttgtgactaactcggttaaagtctgggctaaactcaaccagtacaaacctattcatgcagtgggaaacaaagctttgccactggctgcaaacttgtctggtatgtacaacgagttggtgactaacatgaccaagactggttaccctgtggttggttatcttccgttagttcctgttgatgacattgtcaaggcttatgaaagggaacaagatgcagcgcaaaagaaaggagatactaccactgttactgatgggaacmaatcatcttctgrttcggacactgattgaaacatttgtgagtctggttgggtacttgtgtaaatgatcttataggctcttcatgtcctcttgatcacagaactggtctgtagggttcattctgtgggtgatgtgtgttttctatcta

SEQ ID NO: 170 - DNA, 2045 bp, Hordeum vulgare
aggacgatcccttcatagacgacgacatccctgacgacttcaggcgtgggaagctggacgctctcaccatactgcagtggctcggcctggtgctcatcatcggggcattggtgtgcagcctcacgataaagcccttgtcccggaagaaggtctgggagctgcacctstggaagtgggagctcctcgtgttcgtgctcatctgcggccgtctcgtctccggmtgggtcatccgratcgtggtgttctgcgtckagcgcaactkcgtgctgcrgaagcrcgtgctctacttsgwgtacggcgtgcgcggcgccgtgcakaacgcgctstggctcggcctggttctggcctmttggcacttcttgtttgacgagaacgtccaacgggagaccaacacggcrgygctgcctacgtgaccaargkgctcttctgcttcctcgtcgccacgctcatccgcctcgtcaagacgctgctgctcaaggtgctggcctcgtccttccatgtctcgacgtactttgatcggattaagaggcattgttcaaccagtatgtcatcgagacgctctctgggccgccgcttgttgacgaagactacgtgcttgccgaggtgcgtgagctgcaacgggcaggcgcaaccatcccgaaagagctacgtggtgccttgccggccaagaatctttcggggcaaaagagcatccggatctcgggcttaatttccaagggagaccaatcgagcaggcagctgtcaaaggagaagaaacagcgtgagattgatgaagggatcaccattgacaagctccacaggctcaatcagaaaaacgtctcggcatggaacatgaagaggctgatgaagattgttcgttttgggacgctcaccacaatggacgagcagattcagcaggcaacgggagagggggacgagtcagcgacacagattcgcagcgaatatgaggcgcaggtggccgccaagaagatctttcataatgtggctaagcctggatccaagtacatatacttggcagacatgatgcgcttcatgaggcaggaggaagccatcaaagctatgcatctttttgaaggggcacaggagcactgtagggtcagcaggaggtctctgaagaactgggtggtgaatgcatttagagagcgcaaagctcttgccctaacacttaatgatacaaaaactgcagttaacaagctcaaccagatgtgcaatattgttgttggcctcatagtgtctgctctctggcttcttattctgggcatagcgacgacacatttctttgtcttcatcagttcacagcttcttgtggcagtwtttgtgttcgggaatactatgaagacaatttttgaggcaattattttcttattcgtgatgcatcctttcgatgtyggygaccgctgtgarattgaagargttcaggtygttgtrgaggaaatgaatatcatgacaacagtctttcttcgttatgataacctaaagatctattatccaaacagtgtactggccacaaaaccaattttcaatttctataggagtcctgatatgggagaaggggttgacttctctattcatgtcgccactcctatggaaaaactcacgctcatgaaggaaagaatactacgttacattgacagtaagaaggaacattggtaccctggtgcgatggttgtcctccgggatgtagatgagaccaacaagctgaaagtatccatatggctacgacacacgcttaacttccaggacatgggtatgaggttcgtgaggagggaacttgtgctccaagagatgattagagtcttgagggacctcgacatcgagtaccgaatgttgccgctcgacgtgaacgtgcgaaacacgccccctctacaatccacaaggatgccgacgacgtggaattattcatgaagtggtggtgcatcttcccgttatgagatcgcggatacaacaattaccatccatgtctagtggtgacaactggtagcaactattgccagtagcaaatactccttttgttatcaataagtggacatacagatttttaaaat

SEQ ID NO: 171 - DNA, 2049 bp, Populus trichocarpa
cttgttaagggtttttgttttacctcatcataatcacacctttcccctttttttgttctcctccctcccgatatccatcccctcttctttcaagttggaagctttttatgagctggtgtttaaaggtttcaagaattgaatgtaataagatgggttgtttcactgttttaaagtgcaaaaagaaaaggcctgagccgtcagtttccatcaagcgtgtcagtcctaaggagcaaataccaactactctacctgagccacaggtcccaacacgttcattgcagtcagcaccccctagttttcggaccagagtgaagcctgttcaaccagaaaacaaagtacctagcaacagggcacgggcattatcggctccagaaagccttgatgcagcagaacaagatgctcttgcatcagctgaatatgatgagcaagaggagtcaaaaaaccgaattggaatttcaaaggaacaacggctaccgggtccacaacctcttccactcccttcacctcagggtggtgctatactgaagcctatgagtagctttaaatcagtgaatagcagtggctctctttatgcttctggtccgttgccactgcctcgcagtggaacatacagtggaacactcaggaactttccatatgaagaaattcaatctgcttgctgcaatttctcctcagatcgatgtgtctctgaaggcctttcttccataatgttcagggcttcctttggagatgatactgcaagttcgaagaagtttgaagctagtgttattcgccttaacccatctcctcagggtttaaaagaatttattaatgaggttaatacccttgcatctttgcaacatccaaacttatgcaagttgcttggttataatgcacgtgatggctcagaccagagaatgctggtctatgagaggctttatcatggaagcttggaccggttactgtatggaaggtctgatggccctcccattgactggaataccaggatgaaaattgctttatgtgctgcgcaaggtcttgctttcttgcatgaagaagggcctttccaggcaatgtacaatgagttttctaccgccaacatacaaattgacaaagactttagtgcaaagctttcaggatatggttgtgttggccacatccctgaaacagagatctctaacagtacagcggctgccgcaaatctctctgtagagacagtagagagagggctattgactccgaagagcaatgtatggagctttggaatttttcttcttgaactgctcactggccggaaaaatcttgatagtcgtcatcctagagaagagaggaacttggtcaagtggacccggccttttttagctgatgactgtcgactatcgttgattatggatcctctactaaaatgccgtttccctgcaaaagcagcccgcacattggcagacattgctctaagatgtcttcagaaggatcctttagaaagaccaactatgagaaccattgtggaacatctcaaagtcatacaagacatgaaatactccagtcgctttcctctgcaagagccagcagcagttgctggtaaacaaatgtccagatctcctagtctcaatgggatcatcaccccagcaccaaggttaagtttctcaccgtctccaccatccagagcccggccatccatttcccctaccaggcctcgagcattgcctccgtctcttcctccccgtgcttgttcctcaactctctctcttgaggagctagaacggcaagaaagcaggaaatcatcttcgtcggctgttcgaaggccaggtgttgaaggattttgattgttaatatatgcattttttcattttttgaatggcttttcttttaccctttttggtgattcaacagaatatatagaaagataaaaatgtggttcttccaccttcccatccctcgatgttgattagagtggattctagtttgtagatagagtgcaaaccctagttcgactggattcaattagtttcattgtaatcaacaatgctatttacatgatagttttccaaacccatgtttcatgctcttcca

SEQ ID NO: 172 - DNA, 2049 bp, Populus trichocarpa; identical to SEQ ID NO: 171

SEQ ID NO: 173 - DNA, 1721 bp, Saccharum officinarum
  misc_feature (1674)..(1674): n is a, c, g, or t
  misc_feature (1691)..(1691): n is a, c, g, or t
  misc_feature (1714)..(1714): n is a, c, g, or t
acagcagggccgggactcgggagggaggctatccatccatatcccgtccgtgccgcagctgcagctcgmtcggcttctccccccgctccctctttcagcgcagcgcaggaactagcagcccgcggctctcggcggtacagtacagtggtgacaagatgaagatctccctcttcctcgtgccgctgctcatcacactcctttctccaaatggtcctctcccatcagccgtcgcgctgaacgtgaaaggccgcctggtgaagaccaagaccttcctgtccccgcccatcttcctgcgcccgggcgacgtcgccgacaagtactactacgacatcgccttcccgagaggccacctggcgctcaagagcttcaacggcgaggtcgtcgacgagaacggcgtcccggtacctctccacgagacgtacctccaccactgggtcgtggagccctactacgcggcgaaggacgccacggccgcggcggcggagggccgcccaaggaagctcccggcgcggaactccggcgtgtgcaaccacacgctggggcagtactacgggctcgggtccgagacccggcgcaccgccacgtgggtgcccgacccgtacggcatcgagatcggcgaccccgacgcggcgccggaagggtacgaggagcggtggtttctcaacgtgcacgccatcgacacgcggcgcgtcgtcgacaagctggcgtgcaccgagtgccgctgcgacctgtacaacgtgacggtggaccagcacggccgtggcctccccggggactacgccggcggcctgcgctgctgctacgacgagacgcggtgcgcggtggaggagggcgcgttcgccgtgaacggcggcgagcccaggaaggtgttcctgcgctacaccgtgatgtggcaggactggagcgacgcggcggtgctgcccgtcaagatctacatcttcgacgtcgccgcatgcaaggtggagtaccaggtggaggagtgcgccggtgccgggaacgacggcggcgagtgcgtccacgtgcagacggccacgcaggtgctgccgcggggaggcgacgtcgtgttcggcgtggcgcaccagcactcgggcggcatcggcgcgtccctgcacggcgatgacgggcgcctgctgtgcgagtcgaccgcgacctacggcgagggccaggaggctgggaacgaggcggggtacatcgtcggcatgtccacgtgctacccgaagccgggtgacgtgaaggtgcgcgacggcgaggctctcaccgtggtgtccaggtacagcagcgagcgccggcacacgggcgtcatgggcctcttctacatcctcgtcgccgagcaccagcagcagccgggcctgtgcttcagcttcccggtttcatggtgtctaccgtcatggctgtcaagtaacctgtgagaatctttcttgttgaatggtgcaagagttatgccttgaagaagtagaaataaactactgtatgttctagtagtaggcttctagcaagcagccaagcatgcaggccatcgagttgttgtgttacttgaaagaaccatcagcaagagtctcctttggtgacctgtaaactgtaaggctgtaacacactggtacactacasyaagctgggttttgcagtagtagcaaaagaactgttctagtgtaaaggaaaaaaaacccgaaaaancccaccagggcgccgtntagttgatgaagctcacgacggntatcgga

SEQ ID NO: 174 - DNA, 1721 bp, Saccharum officinarum; identical to SEQ ID NO: 173
  misc_feature (1674)..(1674): n is a, c, g, or t
  misc_feature (1691)..(1691): n is a, c, g, or t
  misc_feature (1714)..(1714): n is a, c, g, or t

SEQ ID NO: 175 - DNA, 2082 bp, Hordeum vulgare
accctctcccaaaacaaacggcataaaccacggcctcggcccgctccgtctccgctcccccacttccagtccactccccttccttccttcccctcctctccagcctccaccccctcaagcgaagcgaaggcaccggatggcggcgtcccctacccccggcggcggcggcatcggggccatcctcgccgccggcgacagggactacctcgtccgcaactccggcgagcaggtgaagatcagcggcattgaggsagacactgtggctctgtatttctcggcctcatggtgcccgccatgccggcggtttacgccaaagcttattgaagcatacaaagaacttacctcacttggcaagagctttgaggtggtctttgtttcaggtgaccaagatgaggaagcattcaatgcctattttgcaaagatgccgtggttggcagttcctttctctgactctgaaggacgtaaaaaccttgatgagcggtttgaggtcaacggtattccacaccttgttttccttgatgcaaaaactggtgaagttcttactgatgaaggagttgagtttgtaagtgaatatggtatagaagcttatccttttacaactgagaggatcaatgaattgaaggaacaagaaaaggcagctaaggataatcaaactattcatagtgtgcttggtacagcaaatcgtgcctacgtaatttcaaacacggggaagraggtacccatcgttgatcttgaggggaagtatgttggtatatgctttgtagtgaacggctatcctccagttgaggaatttacctcagtgcttgccaagatatatgcgaaactcaaagaagtgggggagaagtttgaagttgtagctgtatccttggacagtgacgaggagtcattcaatacgagtttttcaagcatgccttggctcgccattcctcagggcgacaagatgtgtcagaagcttgtcagttactttgagcttagtgatcttcctacactagtgctgattggtcctgatggtaagacactgagcagcaatattgcgggcataattgatgagcatggtttggatgcatgggaggggtttcccttcagtgcagagaagctggaaattctagctgagaaggcaaaggctaaagcagcgtcacagacattggagtcccttttggttactggtgatttagactttgtcatcgggaaagatggagcaaaggttcctgtagcagaacttgttgggaagactgtcctcctctacttttcagctaaatggtgtgggccatgcagagccttcctgcctacacttgtggatgtctacaacaagattaaggagaagaacagcgattttgagatcgtcttcatctccagcgacaaggaccagagctcattcgatgacttcttctctggcatgccatggctcgccatccccttggaggacgaaaggaaggcggacctgaaaaagaggttcaagatccgtggaatcccttctctcgtcgccattggtcccgatgggaagacggtcaacacggacgcaaagacttcgctggcggtccatggcgccgacgcgtttccgttcaccgatgagaggatcgaggagctggagaagaagatcgacgagatggcaaaggggtggcctgagaagctgaagcacgagctccacgagcacgagctcgtgctggtgcgccgccgcaggccgtacggctgcgacggatgcgaggagatgggcaactcctggtcctacaactgcgcggagtgtgacttcgatctgcacaccaagtgcgcgctgggtgaggagaagaagggagaggaggtgaaggggcaggaggatgctgctgccccagctgggtacgtgtgcgagggagacgtctgcaggaaggcatagggtagggttgtgtgtgtgtattccttgccagctgaagcgtgtctgaatcatgtgctgtgtagtgtgatgataaataaatctgtgcatccgatggtttgtcttgggaggtatttgtcctggtgacatttatgtgcaaaattgtccagtatatggtttcagatagttcctgtttttggcatttgcgccttttatctttgtgtttggtttctgtc

SEQ ID NO: 176 - DNA, 2082 bp, Hordeum vulgare; identical to SEQ ID NO: 175

SEQ ID NO: 177 - DNA, 1087 bp, Hordeum vulgare
acgaggcgccagtccaaatccaaacccgaaggagggagagaggctaagctagggttccgcctcccaccggccggagagagagagagagagagagagggatgacgacggcggcgcggcctacgtgggcgccggcgaagggcgggaacgagcagggcggcacgcgcatcttcgggccctccgggaagtactcctcccgcgacctcgccgcccacacctccctcaagcccagaaaagagggacaacaaactcaagaggaggtacagaagaggaatcttagggatgaacttgaggagcgtgaacgcaagcacttctcatccaaggataagtcctatgttgacgagagggaccggcgaaaaagttcaagcctgcttttagaaggttcaaaaagggatgaagataagatagttccacgtgaaattgatgcagacgactctgacgtggagctcaaaagtgatgatgaaagcgatgatgatgacgatgacgatgacaccgaggccctaatggcagagcttgaaaggattaaaaaagaaagagctgaggacaggcttagaaaggagcgtcagcaagcagaagaagaggccaagatgaaggaggctgagctgatgcgaggaaacccgctgatcaatatgaataactccggctccttcaacgtgaagagaaggtgggatgatgatgttgtattcaagaaccaggctcgtggagagaccaagacaccgaaacggttcatcaacgacaccatcagaagtgatttccaccgcaagtttctgcataggtacatgaaatgatgctgctgtacgctttatgttgtatggacagtatgcatgctggaagagcctgtgatgtttctgtattccgaacatcgatttgtatgacataactgtaatatctttgttatcgtacgatgatatgttcaccctgttcctaagagtacagaaaagaacccactgcttgtatattactgatgctttgctgtgaccccaggatctttctattactagtatttactattgaattctttcagacccaccttgacctagaaaatatgtatgcttgtggtgtactcagtttgtgtgactgcccagcaatc

SEQ ID NO: 178 - DNA, 1087 bp, Hordeum vulgare; identical to SEQ ID NO: 177

SEQ ID NO: 179 - DNA, 2737 bp, Vitis vinifera
tgttaatctaaacccttggaagtctctagaaccaggtctgccttcagctttctctacataaaagcccctctcttacccccgagcctccacgcccagatataacatttgctgcattctctcatagccttctgattttgtcgcactctcgcattttctctccgtttcttggcatttcctttactttttttcttgagaaatggatgaggattttgacattccagctgcggaagagatgaacgatgacatggatcttcccgatgagagccccatcctcaaggtcggggaggagaaggagatcgggaagcagggattgaagaagaagcttgtcaaggagggtgaaggctgggacacccctgaaaatggcgatgaagttgaagttcattacactgggactttgcttgatggaactcagttcgattccagccgtgatagggggactccgttcaagttcacccttggccaagggcaagtgatcaagggatgggaccaaggaatcaagaccatgaagaagggtgaaaatgccatcttcactattcctcctgaattggcctatggtgagtctgggtcttcaacaaccattcctcccaatgccactctccaattcgatgttgaactgctatcttggactagtgtcaaggatatctgcaaggatggtgggattttcaagaagattgtcactgaaggagacaaatgggagaaccccaaggaccttgatgaagtgtttgttaagtatgaggctcggctagaggatggcaccttggttgcaaaatctgatggtgtagagttcactgtcaaagaggattatttctgtcctgccctgtccaaggctgtgaagacaatgaagaaaggagaaaaggttattttgacagtgaagccacaatatggatttggggagaaaggcaaaccagcctctggtgaggagggtgcagtcccaccaaatgcaacacttgaaataactcttgagttggtatcatggaagactgtgacagaggtaactgatgacaaaaaggtcatcaagaaaattttaaaggaaggagagggatacgaacgtccaaatgaaggagctgttgtcaaattaaaattgattggaaaattgcaaggtggaacagtgtttctgaagaagggtcatggtgaaggagaggatctcttcgagttcaagactgatgatgagcaagttatcgatgggcttgatagagctgtaatgacaatgaagaagggtgaggtagcccttctcactattcattcagattatgcatttggctcatctgagtcatcgcaagaattggctgtggtccctcccaactcaacagtctactatgaagtggagcttgagtcctttgttaaggacaaggaatcttgggatatgaacactgaagagaagattgaggctgctggcaagaagaaggaagaaggcaatgtgctattcaaggctggtaaatatgcaagagcctcaaagagatatgagaaggctgcaaagtacattgagtatgattcctcttttggtgaagaagagaagaagcaggccaaaactctcaaggttacttgcaacctcaataatgcggcatgcaagctgaaattgaaagactacaaggaggctgagaagctgtgcactaaggttctagacattcaaagtaagaatgtgaaggcactttacaggagggctcaagcgtatattcatctggcagatcttgatttggccgagtttgatattaagaaagctcttgaaattgaccctgataacagggatgtaaagctggagtatagaactttaaaggaaaaaatgaaggagtacaataagaaagaggccaaattctatggcaacatgtttgcaaggatgaacaagttagaggcactcgagaccaataaagcaactaaggaggcagaaccaatgagcatagacagcaaggcataagtggagtttaaaatgaacttcagttgtgtgatgatgatacagaatgaaggctcaatatttctgtctttcttctgctttgttctttttcttggttttggaaccacttgggggtctttggcattgagagtttataatggattgttgacataaattgttattgctataactaccattaacaaattataactgccaaggaagtagtgtttcaacttgtcacatattctgaatgttgaaatgccttgagaagtctatttaagatcttatgatactatctgttgtttcaaaaattatagtagcaaatgtttgttttgttgtaggctttggactgcgcaagatagtgagagcagcgggtccgttgttcagaatagtgctttttcgtgggatcaagaggaatattggaatgtgtttttcctttgatcattgttcatggtttttgagttatgcatacgtagggatggtacttggggagggaggttttttgaagcccctccacatcatctggctctgaatccttcctgccagttggctcacttcctatggacgacatgattcacccatcacacattcttctcataggacgtcaatacctcaagatattgttgcatggttggaggtgcctgggcgcaaggcatgatctgagtgtggtttgtgcacataatataaaaaaaattaaatgcgatgtactcgtatgtcaccagatgtattggaaaattccaacccacatcagacggactcacatgttatttaagagttcgaattccaacaagaacatgaaaaccattcaagacttgtattcctcgagaaggtgattgattattagaaaca

SEQ ID NO: 180 - DNA, 2173 bp, Populus trichocarpa
cttctccattctctcctcctcgacaacaaaacagattgcttcttcttccaagccttcttttcgtccttcatctttccacactaaccccccctctcatcttttctttgtatgataaaattcatttaatttacagaagaggaggaggaggaagaagaagaagagtacaagaattcacttcctttgattgatacaacgttagatttatctgtctggaaccctattgtggcatcatcaatctacagaaacattcatatcaccctgtctctcattttttttcccaatttattgttcttctctgtcctcttctaccaacccaagggaagagaacctgcaccgaggaaggagacgccgtctctctctttttccctcgtcattttttttaattggtaaatgattgtctgagcagagcagacttggtgaatgagcatagcgatcggccaaagggatcacagaaaagaccatggagagatttttattagctgtggacaccatgggagcaaatcaggtgggaggaggacagactctcttgggcaccatcaaaattgctgttctgcccattgccaaagtttttaccatgtgcttcttgggatttctcatggcctccaagtatgttaacatcttgcctgctagtggaaggaaactcttaaatgggttggtgttttcacttttgcttccttgtttgatattttctcaacttggacaagctgtcactttacagaaaatgttggagtggtggtttattcccgtgaatgttgttcttagctccatctgtggctcgctaataggttttattgttgcatccattgtccggccaccttacccattcttcaagttttcaattgtacaaatcggaattgggaatattgggaatgtgccacttgtcttgattgcagctttatgtagagatacatccaacccttttggtgactcggaaaaatgtagcacagatgggactgcctacatctcgtttggccagtgggttggtgcaatcattctatacacatatgtatttaacatgttggcacctccaccggaaggtacctttgatattgatgaaccgaatcttcccatcaagaagccagccaaagatgctcccatggagcaagtccccttgcttgcccaggaggaggcaccggcagaaccagatgctccaaagagagggaagatcaaacagattcttgtctttctctatgacaagttgaagctcaagcaaattcttcagccccctatcattgcttcgatcctagctatgttccttggtgcagtaccgttcttgaagcaattgatctttacaactgattctccccttttctttttcactgacagctgcaatattcttggggaggccatgattccatgcattttgttggcgctaggaggcaatctcgttgatggacctggaagttctaaacttgggtttcggacaactgctgctattatttttggtcggttggttttggtgccacctactggacttggcattgttatgttggctgataagcttggcttccttcctgctggtgataagatgttccggtttgttctgcttctgcagcatacgatgcctacatctgtcctttctggtgctgtggccaacctaagaggatgtggaagagaagctgctgctgtcctattctgggttcatatttttgctattttctcaatggctggatggattgtcctttatctcaacatactcttctgaaactgctgatcaagccattgctgacatggagctatctccagttgcaatttatattaccgcctactcaggtcaatagccaagtagatgaccaaaaacttgaaacaactcttctttttgtgagactcaagcctgagacctcttgaagggcggtggacattggcaccaattgcgctgcaagctcagtggaagcagctattgtttgcgtagcctatgtttataagatctgcaggaaggagctccggaatactcatttaaattcaatttaattctgtttttcatccatcagctgccatatcgttcttaatgtttttctcattggttaattttttctgtatttccgttcctgtaagtattcagttatgtagaaccacatcgaagtgtatggcgatgagactggtttcgcaatcaagttatgccaacttaagcttggatatcctccttgagatttataggttacagtcattttac

SEQ ID NO: 181 - DNA, 2173 bp, Populus trichocarpa; identical to SEQ ID NO: 180

SEQ ID NO: 182 - DNA, 725 bp, Brassica napus
gaacaacaaaacacgaagaatcataagctatatatatttttgtaacatctttgaatattactaagcaggaaaaatgcagtcgatgaaggaaacagcttcaaacatcgcagcttctgccaagtctggcatggacaagaccaaagccaccttggaggagaaggctgagaagatgacaacaagagaccctcttcagaaagagatggctacacagaagaaagaagggaggatcaatgaggctgagatgcagaagagagaagcgcgcgagcacaacgctgtcatgaaagaagccagtggagctggaactggaaccggtttgggaatgggaaccgccactcactcgaccactggacacgttggacacggaactgggacccaccagatgtcggctttgcctggtcacggcacgggacaaccagcgggccacgttgtggatggtacagccgtgacagaaccgataggaacgaacactggaaccggtaggaccaccgctcataacacccgcgtcggtggtggcaccactgggtacggaaccggtggaggatacactggataagacgttttgtcatttgttatgttcttgttaacttgtgctttgtgtgttcatgtttttttttttcggtcctgcctttgtttttcttataaccgtaggactttgctttcgtgtgtgctgtttttggtctgatgacagacttaacagttgtggttttctgaataaactgttgtgt

SEQ ID NO: 183 - DNA, 729 bp, Brassica napus
gattgaacaacaaaacacgaagaatcataagctatatatatttttgtaacatctttgaatattactaagcaggaaaaatgcagtcgatgaaggaaacagcttcaaacatcgcagcttctgccaagtctggcatggacaagaccaaagccaccttggaggagaaggctgagaagatgacaacaagagaccctcttcagaaagagatggctacacagaagaaagaagggaggatcaatgaggctgagatgcagaagagagaagcgcgcgagcacaacgctgtcatgaaagaagccagtggagctggaactggaaccggtttgggaatgggaaccgccactcactcgaccactggacacgttggacacggaactgggacccaccagatgtcggctttgcctggtcacggcacgggacaaccagcgggccacgttgtggatggtacagccgtgacagaaccgataggaacgaacactggaaccggtaggaccaccgctcataacacccgcgtcggtggtggcaccactgggtacggaaccggtggaggatacactggataagacgttttgtcatttgttatgttcttgttaacttgtgctttgtgtgttcatgttttttttttcggtcctgcctttgtttttcttataaccgtaggactttgctttcgtgtgtgctgtttttggtctgatgacagacttaacagttgtggttttctgaataaaactgttgtgt

SEQ ID NO: 184 - DNA, 2096 bp, Vitis vinifera
  misc_feature (1298)..(1298): n is a, c, g, or t
gggaaaccgaagaacgacagacagaatggcagccaaagtttaacaatttratcactctgattttgaatcaagaatttctaaatatagagacgtgtcgtgcctcatttkaccttcatctctcttcaaaccctagacctctctattcctcaactaccacyactcgtagcgcttttctatatataaatatttggtaattatggcgaggaagatgcttattgatggggagctgagcaagcctaatgaagaggagacccattatgactttgatttgtttgttattggggctggaagtggtggcgttcgtgctgccaggttttctgcgaattttggggctaaggttgcaatstgtgagcttccctttcacccagtcagctcagaagtaattggaggggttggtggcacgtgtgttatccgtggttgtgttcctaaaaagattttggtgtatggagcatcttttagaggtgaaattgaggatgccaagaattatgggtgggaattgaatgacaaagtggactttaactggaaaaaacttttacataagaagacagaggaaatagtcaggttaaatggaatttacaagcggttactgacaaatgctggggtgaaactgtatgaaggagaggggaagattgttggtcctaatgaagttgaggtgacacaactagatggcactaagttgtgttattcagcaaagcacatattgattgcaactggtagtagggctcaacgtccaactattccagggcaggagttgtctattacctctgatgaggctttgagtttggatgagttgcccaagcgtgctgtaatactagggggagggtacattgctgttgagtttgcttcaatatggaatgggatgggtgttgctgtagatctatttttcagaaaggaacttccattaagaggttttgacgatgaaatgagggcagtagttgcaagaaatctggaagccaggggaattaatctgcatccaaggacaamtttatcagagttggttaaaacggaagatggaataaaagttatcacagatcatggtgaagaattgacagcagatgttgtactttttgccactggtcgggcgcctaacacaaaaaggttgaacttggaagttgtaggtgtggaattggacaagatgggagctgtgaaggtagatgagtactcccggactaacatacctagcatatgggccattggtgatgttacaaatcgaatgaatcttactcctgtggccttaatggagggaacctactttgcaaaaactgtctttggtgggcaacctagcaaacctgactacnaggatataccttgtgctgtgttctgtttaccacccctttctgttgtgggtttgagcgaagaacaggctacagatcaagcagagggagacattttggttttcacatcaaccttcaatccaatgaaaaacacaatctctggacggcaagagaagacaattatgaagcttcttgttgatgctgagacagacaaagttcttggggcatctatgtgcgggccagacgcacctgaaattatgcagggcattgctgttgcactcaagtgtggagcaactaaggcacagtttgactgcacggtgggcatacatccttctgctgcagaagagtttgttacaatgcggtcagtgacaaggcgtatcgcagcgggcaacaaaccaaagacaaatctttaaagatgatcaatagaaattgtagaacatggttgggttggaaggagagagacatgttttctcagaagtaaatttatttcagtgttaatttatgggatagtagacgacaaaaaattcatgaaaggcttaataaaaggtgagggaaattgaagcagcgttggttaagacagttgagtgaagtaaagggtgtggccatgttctgtaaaatctcatttaatttgatatggatcagtctttcccatgtaatgcaaaaaataaaaatctcaggccttaatccttgttcaataagccagacatcctaggataagatggcatcttcctttacaccccaatgttttatgaaatataggaccaaatttgttttaaagatatgttacaaaggtggtttttttttaagaaccatattctttct

SEQ ID NO: 185 - DNA, 2008 bp, Vitis vinifera
aacaatttgatcactctgattttgaatcaagaatttctaaatatagagacgtgtcgtgcctcatttgaccttcatctctcttcaaaccctagacctctctattcctcaactaccactactcgtagcgcttttctatatataaatatttggtaattatggcgaggaagatgcttattgatggggagctgagcaagcctaatgaagaggagacccattatgactttgatttgtttgttattggggctggaagtggtggcgttcgtgctgccaggttttcagcgaattttggggctaaggttgcaatctgtgagcttccctttcacccagtcagctcagaagtaattggaggggttggtggcacgtgtgttatccgtggttgtgttcctaaaaagattttggtgtatggagcatcttttagaggtgaaattgaggatgccaagaattatgggtgggaattgaatgacaaagtggactttaactggaaaaaacttttacataagaagacagaggaaatagtcaggttaaatggaatttacaagcggttactgacaaatgctggggtgaaactgtatgaaggagagggaaagattgttggtcctaatgaagttgaggtgacacaactagatggcactaagttgtgttattcagcaaagcacatattgattgcaactggtagtagggctcaacgtccaactattccagggcaggagttgtctattacctctgatgaggctttgagtttggatgagttgcccaagcgtgctgtaatactagggggagggtacattgctgttgagtttgcttcaatatggaatgggatgggtgttgctgtagatctatttttcagaaaggaacttccattaagaggttttgacgatgaaatgagggcagtagttgcaagaaatctggaagccaggggaattaatctgcatccaaggacaactttatcagagttggttaaaacggaagatggaataaaagttatcacagatcatggtgaagaattgacagcagatgttgtactttttgccactggtcgggcgcctaacacaaaaaggttgaacttggaagttgtaggtgtggaattggacaagatgggagctgtgaaggtagatgagtactcccggactaacatacctagcatatgggccattggtgatgttacaaatcgaatgaatcttacccctgtggccttaatggagggaacctactttgcaaaaactgtctttggtgggcaacctagcaaacctgactacaaggatataccttgtgctgtgttctgtttaccacccctttctgttgtgggtttgagcgaagaacaggctacagatcaagcagagggagacattttggttttcacatcaaccttcaatccaatgaaaaacacaatctctggacggcaagagaagacaattatgaagcttcttgttgatgctgagacagacaaagttcttggggcatctatgtgcgggccagacgcacctgaaattatgcagggcattgctgttgcactcaagtgtggagcaactaaggcacagtttgactgcacggtgggcatacatccttctgctgcagaagagtttgttacaatgcggtcagtgacaaggcgtatcgcagcgggcaacaaaccaaagacaaatctttaaagatgatcaatagaaattgtagaacatggttgggttggaaggagagagacatgttttctcagaagtaaatttatttcagtgttaatttatgggatagtagacgacaaaaaattcatgaaaggcttaataaaaggtgagggaaattgaagcagcgttggttaagacagttgagtgaagtaaagggtgtggccatgttctgtaaaatctcatttaatttgatatggatcagtctttcccatgtaatgcaaaaaataaaaatctcaggccttaatccttgttcaataagccagacatcctaggataagatggcatcttcctttacaccccaatgttttatgaaatataggaccaaatttgtttta

SEQ ID NO: 186 - DNA, 1198 bp, Gossypium hirsutum
gaagctcatcctcagaatacatcctagaatataacaaaaccctccaaaaaagactttgtacggaatgtcgcagttgttggagaaggcgaaggacttcgtggtggataaggtggccaacataaagaagccggaggctagtgtctcggacgttgatctgaaacatgtgagccgtgagtgcgtcgagtatggcgctaaggtctctgtctccaacccctacagccattccatccccatttgtgagatctcttacaatttcaaaagtgctggaagagggatagcatcagggacaataccagacccggggtcattgaaagccagcgacacaacgatgctggacgtgccagtgaaggtaccgtataacatcttagtaagcttggtaaaggatattggtgcagattgggacattgactatgaattggaattgggtctcaccattgatcttcctatcgtggggaacttcactatccctctctctcagaaaggagagatcaagcttcctactctcagtgacatcttttagatttatcattagtatgtctctctcatactcataaaacttgtgtgttttcccttttactcatgctgtaacatgaagaatatatcgaactatactaggttgtttttcttttaatatgatacatcttttgctttattactcaacagagtaaatgcccagctttatttatttttttggtctgaagaatcagggtcctttacttaatgattaaggcagaaattttattagacttcacttaacctttacccaacaggacaaggaagacataaatacaatgctgcgagcctgcctgccaacgaacaaatcaaggctgattcaacctttttctcttaccctgaagctaagacatattcactgaattcgttgccaaactttgggaaagattccatactttcccactgctcgcaataattcccaaaattttaacagtttttccattggccaattggacgagatggaaattcattttcacaaaaagctaaaacagggatcattcaggatgaaaagacgaaactagtacactttctccccagaaggaaataataagaataggcatttgcagtttcgagtgggagataacgatataggagtagcaacgcaacagtctttaaaaaaggttttcctaggtataatacctctctttcggccttggcctggttcttatactctattctttttatt

SEQ ID NO: 187 - DNA, 1249 bp, Gossypium hirsutum
cagatgcctcctccgctctatttaagtaaatggaaaaaatcgagcattggcgaagctcatcctcagaatacatcctagaatataacaaaaccctccaaaaaagactttgtacggaatgtcgcagttgttggagaaggcgaaggacttcgtggtggataaggtggccaacataaagaagccggaggctagtgtctcggacgttgatctgaaacatgtgagccgtgagtgcgtcgagtatggcgctaaggtctctgtctccaacccctacagccattccatccccatttgtgagatctcttacaatttcaaaagtgctggaagagggatagcatcagggacaataccagacccggggtcattgaaagccagcgacacaacgatgctggacgtgccagtgaaggtaccgtataacatcttagtaagcttggtaaaggatattggtgcagattgggacattgactatgaattggaattgggtctcaccattgatcttcctatcgtggggaacttcactatccctctctctcagaaaggagagatcaagcttcctactctcagtgacatcttttagatttatcattagtatgtcgctctcatactcataaaacttgtgtgttttcccttttactcatgctgtaacatgaagaatatatcgaactatactaggttgtttttcttttaatatgatacatcttttgctttattactcaacagagtaaatgcccagctttatttatttttttggtctgaagaatcagggtcctttacttaatgattaaggcagaaattttattagacttcacttaacctttacccaacaggacaaggaagacataaatacaatgctgcgagcctgcctgccaacgaacaaatcaaggctgattcaacctttttctcttaccctgaagctaagacatattcactgaattcgttgccaaactttgggaaagattccatactttcccactgctcgcaataattcccaaaattttaacagtttttccattggccaattggacgagatggaaattcattttcacaaaaagctaaaacagggatcattcaggatgaaaagacgaaactagtacactttctccccagaaggaaataataagaataggcatttgcagtttcgagtgggagataacgatataggagtagcaacgcaacagtctttaaaaaaggttttcctaggtataatacctctctttcggccttggcctggttcttatactctattctttttatt

SEQ ID NO: 188 - DNA, 1932 bp, Hordeum vulgare
agtcggccgatccttccttcctcgtctccgtacatwaaagatccatccatccatccgccgctgatcccgcactacagcttagccgcaccgcaccagctctgctccgggatccatcctgccatccacccaggccgtcgtcgtcctagggttccggggctgaccggagttccgttcggccatggcgcggaaggtgctcaaggacggggaggcgcccgtcgccgccgcagacgacggcgggagctacgactacgacctcttcgtcatcggcgccggcagcggcggcgttcgcggctcccgcaccgccgcgggcttcggggccaaggttgcgatctgcgagctcccgttccaccccatcagctccgagtggctgggcggccacggcgggacgtgcgtgatacgtggctgcgtccccaagaagatactcgtctacggggcgtctttccggggtgaattcgatgacgccagtaatttcgggtgggaaatcaacggggacatcaactacaactggaaaaagttgctggaaaataagactcaagaaattgtcagattaaacggagtgtacaagaggatccttggtaattctggtgtgacgatgatcgaaggagcaggaagtatagttgatgctcacaccgttgaagttacccagccagatggttcaaagcaaaggcacacgacgaagcacatattgattgcaactggcagccgagcaactctggtcaacattcctggaaaggagctggctattacttcagatgaagctttaagtttggaggagctaccgaaacgtgctgtgattcttggtggcggatatattgctgttgaatttgcttctatctggaaggggttgggtgctcaagtagatctattttataggaaagaacttcctctaaggggttttgatgatgagatgagaacagttgttgcaagtaaccttgaaggaaggggaatccgattgcatccagggacaaatttgactgagttgagtaaaacagccgatggcattaaagttgtgacagataagggggatgagctcattgcagatgttgttctttttgctacaggtcgtgcgccgaactccaataggctgaacttggaagctgtaggtgttgaggttgatcaaataggagccatcaaggttgatgaatactcccgtacatcagttccaaatatatgggctgttggcgatgtgacgaatcggattaacctaacacctgttgctctgatggaggctacttgctttgctaaaactgtgtttggtggccagacagttaagcctgattataaagatgtaccttgtgctgttttctgtattccgccgctatctgtcgtgggtcttagcgaacaagaggctttggcggaagccaagaatgatcttcttgtttacacatcaagtttcaatccaatgaagaacagcatatccaaacgtcaagagaagtctatcatgaaactggtggttgatgctgagaccgataaggtactcggtgcagccatgtgtggaccagatgcagctgaaattatgcagggcattgctgttgcgctcaaggctggagctaccaaggcgaccttcgacagcactgttgggattcacccctctgccgcggaggagtttgtgacgatgcggaccttgaccaggcgcgtgagcccggcatcgaagccaaagacgaacttgtaagcaagatccctgcaatgttttggacgaaaattatactggtgcggcgacgggaactgtagacgtggactcttgtttcagttcgttagccctgcgcttggcatttgacctgaaagggtgatacggtgtacgtatttgattgtgatagtaataagtttctgcggaacagtttgtacggaaatcgtgggtattgttgtgatttccaagccaaataagcccttgatgttgaaatgttttcccatttagcctgcatgttatgccac

SEQ ID NO: 189 - DNA, 1932 bp, Hordeum vulgare; identical to SEQ ID NO: 188

SEQ ID NO: 190 - DNA, 599 bp, Saccharum officinarum
ctagtggagtagatcagcttagtagctcaagagcagaacgcatcatcaccaatgaggccgctccttgtgcttgctctgatttttgtgattgccggtgtggcgcatggcgcgggggagtgcgggagagcctccgctgacagggtggcgctgaggctggcgccatgcatctcggccgccgacgacccgcagtcgacgccgaccagcagctgctgctcggccgtgcacgccatcgggcagagccccagctgcctgtgcgccgtcatgctgtccggcaccgccagggctgccgggatcaagccggaggtcgccattaccatccccaagcgctgcaacatggccgatcgccccgtcggctacaagtgcggagattacacgctgccctgacgacatccgtcagcgagaccgtgcgagtgattatgacaagctgatgaatgcgccatgcaaggcgttgtgttggaaaaatcgaatccgcgagaataaataagtacacgtggacgacgggcttttgctgtatcactactggactttgcttgtgttgtatgtcaaaaataataaatatgttctgcttctctaatataagaaaaatatgtattgtttgt

SEQ ID NO: 191 - DNA, 599 bp, Saccharum officinarum; identical to SEQ ID NO: 190

SEQ ID NO: 192 - DNA, 856 bp, Saccharum officinarum
ggctccagcgcacgtgtggcgtttctcgctgcgctactgccggctgtcccgagtcccgaccaccgtcctccgctccccgccgcgaatccttcgtcctcccgcgatggagacctgcccgtcggtgaagaacatcctcttgctggactccgaggggaagcgcgtcgccgtgaagtactacagcgatgactggcctaccctcacagcgaagctggccttcgagaagtcggtcttcgccaaaacccagaaagcgaatgctggaacggaagctgagattgtaatgtttgacggtcaaattgtggtatacaagttcatccaagacctgcacttttttgttactggaggagaagaggagaatgagcttattttagcatcagttcttcagggattctctgatgctgttgaacgacttctcaaaaacatggttgacaaaaggacagcactcgagaatttggacctgatcctattgtgtcttgatgaaattgttgatggagggattgtacttgaaacagaaggaagagaaatagctgaaaaggtgtctggtcatggattggagggtgcttcatcagctgagcagactctagtcaacgccctaacgcaagcaagagagcatttcgcgaagtctcttctcatgtgatgctgtgctttatattttgggggtgacgatggagtatctattattgtgtctggataacacattcttttttgttagcaacggagaaagaaaaatgtctgaaatctatgaatgtgttgaatgtcatggtgtttccaaaattctcatgttcattctgtaagccttcaaagttgtgtagcatgattgttctaattttgactggttcagttattggtcgttttgttt

SEQ ID NO: 193 - DNA, 967 bp, Saccharum officinarum
ggctccagcgcacgtgtggcgtttctcgctgcgctactgccggctgtcccgagtcccgaccaccgtcctccgctccccgccgcgaatccttcgtcctcccgcgatggagacctgcccgtcggtgaagaacatcctcttgctggactccgaggggaagcgcgtcgccgtgaagtactacagcgatgactggcctaccctcacagcgaagctggccttcgagaagtcggtcttcgccaaaacccagaaagcgaatgctggaacggaagctgagattgtaatgtttgacggtcaaattgtggtatacaagttcatccaagacctgcacttttttgttactggaggagaagaggagaatgagcttattttagcatcagttcttcagggattctctgatgctgttgaacgacttctcaagttattttccctctattaaagtttatcttttcaaccactgtttctcctgttacatgttattgtgttaatgctgattgtatatgaatgtgtttccaatcttggtggtttcagaaacatggttgacaaaaggacagcactcgagaatttggacctgatcctattgtgtcttgatgaaattgttgatggagggattgtacttgaaacagaaggaagagaaatagctgaaaaggtgtctggtcatggattggagggtgcttcatcagctgagcagactctagtcaacgccctaacgcaagcaagagagcatttcgcgaagtctcttctcatgtgatgctgtgctttatattttgggggtgacgatggagtatctattattgtgtctggataacacattcttttttgttagcaacggagaaagaaaaatgtctgaaatctatgaatgtgttgaatgtcatggtgtttccaaaattctcatgttcattctgtaagccttcaaagttgtgtagcatgattgttctaattttgactggttcagttattggtcgttttgttt

SEQ ID NO: 194 - DNA, 589 bp, Hordeum vulgare
acatcgactcctatcggcggtcgcgcgagctccagcgccaaggggatccgttgcgtccggcgggggttaatttcttgcggttgtaggatccccgatggcggatacggcgaaggccgatgcggcggcggaggcggccaagatggacctgctcgaggacgacgacgagttcgaggagtttgagatcgaccaagaatgggatgacaaggaagaaggcaacgaggcagttcagcaatgggaggatgactgggatgacgatgatgtcaatgacgacttctctctgcagctcaggaaagagctggagagcatcccatcgaagaactagaacttgtggtcttgtattcagtactttcagataggaagtggtatctgctggatttggcatgtttactgttatatttaccaactcgagcattttgcttgttctgtggtatgcctttccgttatacattttattaccaaatacggttcataaaactatattgcctatgtctagaaagtggtatcggttgtagaaccgtaatccatcaactggctgaacctttttgttccgtgaatgcagaaaggccattgcttagtgttttttttatct

SEQ ID NO: 195 - DNA, 589 bp, Hordeum vulgare; identical to SEQ ID NO: 194

SEQ ID NO: 196 - DNA, 1589 bp, Hordeum vulgare
tttctccattgctgcacccttgattcgcgcaaggacgccacggctcgcgctctctctgttggtgggctgctcaggcgcgtggtgcggctggccggcgctgccgtcggcgtggtctcggggctgttttactgccgtgggatcgggtgatggcggcggcggtgttcgccggggacggggccgccgcgcgcggggggtgctcggcggaatgcgccggggggatcgagaggccaccggatctcgggagcagggcgggggacgggtgcggcaagcggagcgtgtacctcatggagtgcgtgccgctgtggggctgcgccgcggcgcgcggccgygccgcggagatggaggacgcgtgcgccgccgtgccgcgcttcgctgccctgccggcgcggatgctcgccagcagccgtgagctggacgggatcgggggcgacttcgatgccgccgagctccggctcccggcgcacctgttcggcgtctacgatgggcacggcggctcggaggtcgcaaactactgccgggataaggtccacgttgtgttgagagaagtgctgagagacggcagggggttggaggaactgggagaagtaggggaggtggacgtgaaggaatcatgggagaaggttttcggtgattgtttccagaaggtagacgacgaggtgtcggggaaagcgatcaggttttccaatggcgtcacggagctccgtccggagcctattgccgctgataacgtcggttccactgctgtggttgcgattgtctgctcttctcatgtcataactgcgaattgtggagattcacgcgtcgtgctctgccgtgggaaggagccgattgctctgtccgtcgatcacaaacctgataggaaagacgagcgtgccaggattgaggccgcaggtggaaaggtcattgactggaatggttatcgtgtctctggtattctcgcaatgtcacggtcaatcggtgaccgatacctgaaaccatttctgattccaaagcctgaagtcagcgttgttcctcgggcaaaagatgatgactgcctcattctagcaagcgatggtctgtgggatgtcatgtcgaatgaagatgcctgcaaagttgcccggcgacagatccttctgtggtacaagaataataacgacggtgcaaattctgatggaggcagcgaacccactatgaatcctgctgcaaaagcagctgcggattgtctcgtgaggctagccctgatgaaagggagcggggacaacattagtgtcatagttatcgacctgaaatcaagaaagaagcccaagggcaaatcctaacatgcccgtaattcacctgactagctgaccgtgtctgcgaccggagtttcgactgctagtctgctttccttgcaagaacggcacgcctactcttttgttttgtttattcagtcgtctgcaagagctgtatgtacatatgctgataggtctacttccgataatctgatgtatggggtgtgtgttggcttgtttatgtgtacccccctagccttttggttttgggctgttcacacttgacttccgtcaggttcagaacagccatgtaatgtagtggtatctgcataataattg

SEQ ID NO: 197 - DNA, 1589 bp, Hordeum vulgare; identical to SEQ ID NO: 196

SEQ ID NO: 198 - DNA, 1946 bp, Solanum lycopersicum
atttattattagatctataaatagcagagccatttttctccacaattttctctttttcattttcattgtgatcttgtgatttctctagatcttctccttttctcaattttgtccaaaaagtttctttatggatacattgttcttcgatataatcaaaaagtttgattgctctctttgttcaacgccagctttgccttttgattcctttctttttcatcgtctgagttttagtcaaacttgtatttgcttctaaccttttgttacctggagctgtcaccatgggtagaagaagttcacaacgtaggaatgctgctatgctggatagtgatgacacggatagcttgagttcatcatcaactactcggtcggatatgatgttgtctggtttagaggaggtgcaatttgacaaggagactgtccttgatcaatgtgtggatgccctttatgagaaaaggggatcaacaagagagaaggctttgacatctattatagaagcattcaatagcaacatacaacatgaatttgttgaaaagaagtttgccacattattgcagctatgtttgagttccattagacgtggttcctccaaggagatagctttggcatctcatgttattgggcttcttgctttaactgctggccctggagacaaagcacacgagattctggaagaatcagtaaaacctatctcagttgctcttaaatctcgatctgacaattctaaaatatcctcgttactggagtgtttggccattatcacctttgttggtggcaaagaacctgaggaaacagaagagtctatgcaattgatgtggcaagtcatcaatccaaaactgggtcccaatgtggctactgctaaaccttcaccagtaatgataacagcagttgtatcttcttggtctttccttcttactaccatggatgggtggacactaaacccaaaaagttggcaagggtcaatctcctacttctcaaatcttctagacaaggaagaccgatctgtgcgcattgcagctggcgaaacacttgctttagtttttgaagttgggagtctggaaaagttttctggtgaatctaaagaatctagtgacagctccgcagatgaaactaacaaatctagggaattattacatatacagggattaagggcaaaagtcctgaaccaagtaagaaccctttcagcagaggctggaggtaaagggtcagccaagaaggatcttaacaatcaaaggaacacattccgagatatattggaatttctagaggatgggtatagtcccgaaacctcagtcaagattggtgggctattgcttagcacaagtacttgggctcatctgatacagttaaacttccttaagcacttccttggaggaggatttgtgaagcatatgcaggcttgttttctaatcaaaagatcaagcttttgggctattggaatcatttaatcttgtggtaattagctgtttcctctccaaattgtgcaggaaaatgagtttcttcatgatgtatttggtttcacaccgaagaagaatctcccagcttctcagcatcgtgtatctggaaccgataagagaaagtacaagtcgccaaattccatccttaacaaagccaggactcaatttctaaacaagcaaagaatgttgtcccaggacaagaatgtcggctactatgagggtggtgatgagttctgaacaagcagttgcagcaacacagccccgcgaaaacatgcaaggacaattttccttggtgtcgtcatactattcattcataatcacagatttaatgaacaaaatgattaaaaaagatagttatttgatcattttggttgctacttggtagtattcccttattttttcttctcattatgtaataaaatacatttggatttgttacctctgatggagttcatcagtagtgcataagaaatgcctgccactttctgttga

SEQ ID NO: 199 - DNA, 1856 bp, Solanum lycopersicum
atttattattagatctataaatagcagagccatttttctccacaattttctctttttcattttcattgtgatcttgtgatttctctagatcttctccttttctcaattttgtccaaaaagtttctttatggatacattgttcttcgatataatcaaaaagtttgattgctctctttgttcaacgccagctttgccttttgattcctttctttttcatcgtctgagttttagtcaaacttgtatttgcttctaaccttttgttacctggagctgtcaccatgggtagaagaagttcacaacgtaggaatgctgctatgctggatagtgatgacacggatagcttgagttcatcatcaactactcggtcggatatgatgttgtctggtttagaggaggtgcaatttgacaaggagactgtccttgatcaatgtgtggatgccctttatgagaaaaggggatcaacaagagagaaggctttgacatctattatagaagcattcaatagcaacatacaacatgaatttgttgaaaagaagtttgccacattattgcagctatgtttgagttccattagacgtggttcctccaaggagatagctttggcatctcatgttattgggcttcttgctttaactgctggccctggagacaaagcacacgagattctggaagaatcagtaaaacctatctcagttgctcttaaatctcgatctgacaattctaaaatatcctcgttactggagtgtttggccattatcacctttgttggtggcaaagaacctgaggaaacagaagagtctatgcaattgatgtggcaagtcatcaatccaaaactgggtcccaatgtggctactgctaaaccttcaccagtaatgataacagcagttgtatcttcttggtctttccttcttactaccatggatgggtggacactaaacccaaaaagttggcaagggtcaatctcctacttctcaaatcttctagacaaggaagaccgatctgtgcgcattgcagctggcgaaacacttgctttagtttttgaagttgggagtctggaaaagttttctggtgaatctaaagaatctagtgacagctccgcagatgaaactaacaaatctagggaattattacatatacagggattaagggcaaaagtcctgaaccaagtaagaaccctttcagcagaggctggaggtaaagggtcagccaagaaggatcttaacaatcaaaggaacacattccgagatatattggaatttctagaggatgggtatagtcccgaaacctcagtcaagattggtgggctattgcttagcacaagtacttgggctcatctgatacagttaaacttccttaagcacttccttggaggaggatttgtgaagcatatgcaggaaaatgagtttcttcatgatgtatttggtttcacaccgaagaagaatctcccagcttctcagcatcgtgtatctggaaccgataagagaaagtacaagtcgccaaattccatccttaacaaagccaggactcaatttctaaacaagcaaagaatgttgtcccaggacaagaatgtcggctactatgagggtggtgatgagttctgaacaagcagttgcagcaacacagccccgcgaaaacatgcaaggacaattttccttggtgtcgtcatactattcattcataatcacagatttaatgaacaaaatgattaaaaaagatagttatttgatcattttggttgctacttggtagtattcccttattttttcttctcattatgtaataaaatacatttggatttgttacctctgatggagttcatcagtagtgcataagaaatgcctgccactttctgttga

SEQ ID NO: 200 - DNA, 1945 bp, Solanum lycopersicum
atttattattagatctataaatagcagagccatttttctccacaattttctctttttcattttcattgtgatcttgtgatttctctagatcttctccttttctcaattttgtccaaaaagtttctttatggatacattgttcttcgatataatcaaaaagtttgattgctctctttgttcaacgccagctttgccttttgattcctttctttttcatcgtctgagttttagtcaaacttgtatttgcttctaaccttttgttacctggagctgtcaccatgggtagaagaagttcacaacgtaggaatgctgctatgctggatagtgatgacacggatagcttgagttcatcatcaactactcggtcggatatgatgttgtctggtttagaggaggtgcaatttgacaaggagactgtccttgatcaatgtgtggatgccctttatgagaaaaggggatcaacaagagagaaggctttgacatctattatagaagcattcaatagcaacatacaacatgaatttgttgaaaagaagtttgccacattattgcagctatgtttgagttccattagacgtggttcctccaaggagatagctttggcatctcatgttattgggcttcttgctttaactgctggccctggagacaaagcacacgagattctggaagaatcagtaaaacctatctcagttgctcttaaatctcgatctgacaattctaaaatatcctcgttactggagtgtttggccattatcacctttgttggtggcaaagaacctgaggaaacagaagagtctatgcaattgatgtggcaagtcatcaatccaaaactgggtcccaatgtggctactgctaaaccttcaccagtaatgataacagcagttgtatcttcttggtctttccttcttactaccatggatgggtggacactaaacccaaaaagttggcaagggtcaatctcctacttctcaaatcttctagacaaggaagaccgatctgtgcgcattgcagctggcgaaacacttgctttagtttttgaagttgggagtctggaaaagttttctggtgaatctaaagaatctagtgacagctccgcagatgaaactaacaaatctagggaattattacatatacagggattaagggcaaaagtcctgaaccaagtaagaaccctttcagcagaggctggaggtaaagggtcagccaagaaggatcttaacaatcaaaggaacacattccgagatatattggaatttctagaggatgggtatagtcccgaaacctcagtcaagattggtgggctattgcttagcacaagtacttgggctcatctgatacagttaaacttccttaagcacttccttggaggaggatttgtgaagcatatgcaggcttgttttctaatcaaaagatcaagcttttgggctattggaatcatttaatcttgtggtaattagctgtttcctctccaaattgtgcaggaaaatgagtttcttcatgatgtatttggtttcacaccgaagaagaatctcccagcttctcagcatcgtgtatctggaaccgataagagaaagtacaagtcgccaaattccatccttaacaaagccaggactcaatttctaaacaagcaaagaatgttgtcccaggacaagaatgtcggctactatgagggtggtgatgagttctgaacaagcagttgcagcaacacagccccgcgaaaacatgcaaggacaattttccttggtgtcgtcatactattcattcataatcacagatttaatgaacaaaatgattaaaaaagatagttatttgatcattttggttgctacttggtagtatcccttattttttcttctcattatgtaataaaatacatttggatttgttacctctgatggagttcatcagtagtgcataagaaatgcctgccactttctgttga

SEQ ID NO: 201 - protein, 228 aa, Oryza sativa
MASAKSGERGSSSFAMACSLLSRYVRQNGAAAGELGLGIRGEADANKGKETMELFPQNSGFGSEAAAVKETPDAREQEKRQLTIFYGGKVLVFDDFPAEKAKDLMQMASKSSSTAQNCVLLPSSATATVADNTKVSAVPAPASALPVAQANAPKPVRPNAADLPQARKASLHRFLEKRKDRLQAKAPYQGSPSDASPVKKELQESQPWLGLGPQVAAPDLSLRQESSQ

SEQ ID NO: 202 - protein, 228 aa, Oryza sativa; identical to SEQ ID NO: 201

SEQ ID NO: 203 - protein, 117 aa, Oryza sativa
MRAGRLVILVAVAVVVVVAGGGAAEGAGECGRASADRVALRLAPCVSAADDPQSAPSSSCCSAVHTIGQSPSCLCAVMLSNTARVAGIKPEVAITIPKRCNMADRPVGYKCGDYTLP

SEQ ID NO: 204 - protein, 117 aa, Oryza sativa; identical to SEQ ID NO: 203

SEQ ID NO: 205 - protein, 449 aa, Oryza sativa
MADESERSGMVIDDVGGGLNLPIIVAGKRKRELTWEEKALTVLDIVGSQQHPACQPAERDCSLIDSEKDYSSMAGCQAGEHASIFGIDKNGDDSDEPCAKDDAKQSDVAPLKEEENWELDSEPELTWDEKVVEVLNIVRRREITEYNPKQFCSIPTRFCAYNIAFFDLDKESKLARGPPIKSLAFPDYWWEMDSVNVIAIKVAESDVGYPIRVFGTVLARDEYDFRCVYLFRRDRNNPQIITSPEDTLTLTGPNRALGAIDKMYFEFNLKIRDGDVDKDFCKGVREHNAICYTKQPMTLSLESCLSRIDFVYSPVQLAVEASVAVKIKGVVSKFFTGKVTAWTTGDDQNKIILYDSEVEGRNRVLGADGSVDLTRCFVAVNLDDELVLNVCVSEGAGSIFELVLGHNDEECVLEQGPYELQVNVVWTAALKHRQRRKLFERIGDFRVLR

SEQ ID NO: 206 - protein, 686 aa, Oryza sativa
MARSRRRCIVQSHEEYLSEEHIAEENAPKQLATPSEQETICSDVQEGNEDTNDDVGEANEDTDDDASMNAGEGNEESDDDVEINVRDENGTIETRGKTKLKDIWNLPKRLRIVVQCNDLNQAVGDEAGILSKFLGMVARNGTLCSLSYTDWRFLIGKRERKTKSLDEFFVGIQMRFLYAPRMEEFILKTIRERWRGHKAKLKEKYFDVNKSKEANCNNVPADVLPDQWIALINHWMSEKSKKISKQNKENCRKKKALHTAGTNSFARTREEMRQKDPAKNPHRAIVYIQTHKRKTGKNLNGHVDNLKKLVVEQPALADTSEGRTAWKGDALNQILGDDKPGHVHGLGLVPKPKQVLDVAKFLTLKEYNVTRLDDNWSEDVVAARLQLEKIENHVQNHDAELLELKAKTNKLEKEQMNQGGLDRVSTNKEASVDGPISKRRRVYSDHPLQEICIAEEENDMVQEENNMMNIQSHVPNEDLQPKTKQCVEDKNKQNWEQHDYGKQRKVISAQKKKTNKENHVMNARKVVEASKNKKEKKNAQSHVRLGQNQPTAAPKKRQCSTTNFIADNSMEDTNIHVQNKVLQLPTKQSTIYKSNQTYGQNHLEKQRKIICVKNKGNMNQNDHMQQGKNNSNAYKVDKINDHDLGQYGYCKVDNCHLKIPCEYDDDCNMEDGGNDSGNFRCMFFFL

SEQ ID NO: 207 - protein, 449 aa, Arabidopsis thaliana
MDIFDNSDLEYLVDEFHADFDDDEPFGEVDVTSESDSDFMDSDFDFELSESKTNNETSALEARNGKDIQGIPWESLNYTRDRYRENRLLHYKNFESLFRSREELDKECLQVEKGKNFYDFQFNTRLVKSTIAHFQLRNLVWATSKHDVYFMNNYSLMHWSSLLQRGKEVLNVAKPIVPSMKQHGSLSQSVSRVQISTMAVKDDLIVAGGFQGELICKKINEPEVAFCTKLTSADNDITNSVDIYNAPSGSLRVMTANNDCTVRLFDATNFALLNRFAFHWSVNNISTSPDGKLVAVLGDSPECLLADTGSGKVIHGLEGHLDYSFSSAWHPNGQILATGNQDTTCRLWDVRNLSQSLKVLKGNMGAIRALRFTSDGRFLAMAEPADFVHLFDTEAGYSQCQEIDLFGEIAGISFSPDTEALFVGVADRTYGSLLEFNRKRNHSYVDSIF

SEQ ID NO: 208 - protein, 540 aa, Arabidopsis thaliana
MNGGDVTVAGSDDLKSPLLPVVHNDEPFERQTVGQQLRTIFTPKNCYIALGPLLCAVVCLCVDLGGDETTTARNMLGVLVWMFAWWLTEAVPMPITSMTPLFLFPLFGISAADDVANSYMDDVISLVLGSFILALAVEHYNIHRRLALNITLVFCVEPLNAPLLLLGICATTAFVSMWMHNVAAAVMMMPVATGILQRLPSSSSTTEVVHPAVGKFSRAVVLGVIYSAAVGGMSTLTGTGVNLILVGMWKSYFPEADPISFSQWFFFGFPLALCIFVVLWCVLCVMYCPKGAGQALSPYLHKSHLRRELDLLGPMNFAEKMVLAVFGGLVVLWMTRNITDDIPGWGRIFAGRAGDGTVSVMMATLLFIIPSNIKKGEKLMDWNKCKKLPWNIVLLLGAGFAIADGVRTSGLAEVLSKGLVFLETAPYWAIAPTVCLIAATITEFTSNNATTTLLVPLLIEIAKNMGIHPLLLMVPGAIGAQFAFLLPTGTPSNVVGFTTGHIEIKDMIKTGLPLKIAGTIFLSILMPTLGAYVFASMGGV

SEQ ID NO: 209 - protein, 540 aa, Arabidopsis thaliana; identical to SEQ ID NO: 208

SEQ ID NO: 210 - protein, 273 aa, Oryza sativa
MAPRLLSCFGRGSATASAPDQPEEAAAAAAPGPVLLELFCSQGCGASPEADAVAARMVHEDQQRAAAGEGGGGERGVVVLGFHVDYWDYRGWKDPFASSAWTVRQKAYVEALRLDTLFTPQAVVQGRAHCVGTEQDALAQAVRDTPRYPAPAMKVTFQRPNPSTLQASFTGTLRSRMEGGGSVLVALYESGLVTDCGRGENKGKSLLNDHVVRRLEKVAAVRDGASAKKSVSGSVQFPLWDGFRASRCGLVLFVQNAALQVLGVQHFDLPDNV

SEQ ID NO: 211 - protein, 297 aa, Arabidopsis thaliana
MGVREKDPLAQLSLPPGFRFYPTDEELLVQYLCRKVAGYHFSLQVIGDIDLYKFDPWDLPSKALFGEKEWYFFSPRDRKYPNGSRPNRVAGSGYWKATGTDKIITADGRRVGIKKALVFYAGKAPKGTKTNWIMHEYRLIEHSRSHGSSKLDDWVLCRIYKKTSGSQRQAVTPVQACREEHSTNGSSSSSSSQLDDVLDSFPEIKDQSFNLPRMNSLRTILNGNFDWASLAGLNPIPELAPTNGLPSYGGYDAFRAAEGEAESGHVNRQQNSSGLTQSFGYSSSGFGVSGQTFEFRQ

SEQ ID NO: 212 - protein, 169 aa, Arabidopsis thaliana
MASHQEQSYKAGETRGKAQEKTGEAMGTMGDKTQAAKDKTQETAQSAQQKAHETAQSAKDKTSQAAQTTQERAQESKDKTGSYMSETGEAIKNKAHDAAEYTKETAEAGKEKTSGILGQTGEQVKQMAMGATDAVKHTLGLRTDEGNKEHVSSAPSTTTTTTTRETQRK

SEQ ID NO: 213 - protein, 619 aa, Arabidopsis thaliana
MESQLTRPYGHEQAEEPIRIHHPEEEEHHEKGASKVLKKVKEKAKKIKNSLTKHGNGHDHDVEDDDDEYDEQDPEVHGAPVYESSAVRGGVTGKPKSLSHAGETNVPASEEIVPPGTKVFPVVSSDHTKPIEPVSLQDTSYGHEALADPVRTTETSDWEAKREAPTHYPLGVSEFSDRGESREAHQEPLNTPVSLLSATEDVTRTFAPGGEDDYLGGQRKVNVETPKRLEEDPAAPGGGSDYLSGVSNYQSKVTDPTHKGGEAGVPEIAESLGRMKVTDESPDQKSRQGREEDFPTRSHEFDLKKESDINKNSPARFGGESKAGMEEDFPTRGDVKVESGLGRDLPTGTHDQFSPELSRPKERDDSEETKDESTHETKPSTYTEQLASATSAITNKAIAAKNVVASKLGYTGENGGGQSESPVKDETPRSVTAYGQKVAGTVAEKLTPVYEKVKETGSTVMTKLPLSGGGSGVKETQQGEEKGVTAKNYISEKLKPGEEDKALSEMIAEKLHFGGGGEKKTTATKEVEVTVEKIPSDQIAEGKGHGEAVAEEGKGGEGMVGKVKGAVTSWLGGKPKSPRSVEESPQSLGTTVGTMGFSDSGGSELGGSGGGKGVQDSGN

SEQ ID NO: 214 - protein, 619 aa, Arabidopsis thaliana; identical to SEQ ID NO: 213

SEQ ID NO: 215 - protein, 710 aa, Arabidopsis thaliana
MDQTEEPPLNTHQQHPEEVEHHENGATKMFRKVKARAKKFKNSLTKHGQSNEHEQDHDLVEEDDDDDELEPEVIDAPGVTGKPRETNVPASEEIIPPGTKVFPVVSSDYTKPTESVPVQEASYGHDAPAHSVRTTFTSDKEEKRDVPIHHPLSELSDREESRETHHESLNTPVSLLSGTEDVTSTFAPSGDDEYLDGQRKVNVETPITLEEESAVSDYLSGVSNYQSKVTDPTKEETGGVPEIAESFGNMEVTDESPDQKPGQFERDLSTRSKEFKEFDQDFDSVLGKDSPAKFPGESGVVFPVGFGDESGAELEKDFPTRSHDFDMKTETGMDTNSPSRSHEFDLKTESGNDKNSPMGFGSESGAELEKEFDQKNDSGRNEYSPESDGGLGAPLGGNFPVRSHELDLKNESDIDKDVPTGFDGEPDFLAKGRPGYGEASEEDKFPARSDDVEVETELGRDPKTETLDQFSPELSHPKERDEFKESRDDFEETRDEKTEEPKQSTYTEKFASMLGYSGEIPVGDQTQVAGTVDEKLTPVNEKDQETESAVTTKLPISGGGSGVEEQRGEDKSVSGRDYVAEKLTTEEEDKAFSDMVAEKLQIGGEEEKKETTTKEVEKISTEKAASEEGEAVEEEVKGGGGMVGRIKGWFGGGATDEVKPESPHSVEEAPKSSGWFGGGATEEVKPKSPHSVEESPQSLGSTVVPVQKEL

SEQ ID NO: 216 - protein, 710 aa, Arabidopsis thaliana; identical to SEQ ID NO: 215

SEQ ID NO: 217 - protein, 321 aa, Arabidopsis thaliana
MATIRVPNEVPSPAQDSETLKQAIRGWGTDEKAIIRVLGQRDQSQRRKIRESFREIYGKDLIDVLSSELSGDFMKAVVSWTYDPAERDARLVNKILNKEKKKKSLENLKVIVEISCTTSPNHLIAVRKAYCSLFDSSLEEHIASSLPFPLAKLLVTLASTFRYDKDRTDAEVATIEAAMLREAIEKKQLDHDHVLYILGTRSIYQLRETFVAYKKNYGVTIDKDVDGCPGDADLRSLLKVAIFCIDTPEKHFAKVVRDSIEGFGTDEDSLTRAIVTRAEIDLMKVRGEYFNMYNTSMDNAITGDISGDYKDFIITLLGSKI

SEQ ID NO: 218 - protein, 321 aa, Arabidopsis thaliana; identical to SEQ ID NO: 217

SEQ ID NO: 219 - protein, 177 aa, Oryza sativa
MESCPSVKNILLLDSEGKRVAVKYYTDDWPTLSAKLAFEKSVFVKTQKATAGAEAEIVMFDGHIVVYKFIQDLHFFVTGGEEENELILASVLQGFTDAVDIILRNNVDKRTALENLDLILLCLDEIVDGGIVLETEGSVIAEKVSAHGIEGATSLAEQTIVQALTTAREHLTKSLLM

SEQ ID NO: 220 - protein, 177 aa, Oryza sativa; identical to SEQ ID NO: 219

SEQ ID NO: 221 - protein, 346 aa, Sorghum bicolor
MATAAAATAASTSLLAPAASSTAPGASPNALFFPSSVPSLRAYPRLLLAFRRPAAAAAQGAVLEEEEVQADQRGQYDDDDDGYEGGRGPAFTAPTRPRTGKAALPLKRDRTRSKRFLEIQKLRESKKDYDVPTAISLMKQMSSAKFVESAEAHFRMNLDPKYNDQQLRATVNLPKGTGQSVKIAVLTQGEKIDEARAAGADIVGGEDLIEQIKGGFMEFDKLIASPDMMPKVAGLGKILGPRGLMPNPKAGTVSPNITQAIEEFKKGKVEYRVDKSGIVHIPFGKVDFPEEDLIANFMAVVRSVERNKPSGAKGIYWKTAYLCSSMGPSIKLNIKEMLDYGLDSSD

SEQ ID NO: 222 - protein, 298 aa, Oryza sativa
MSLVSSEHKKSGPSVPSPTPVSPLSVALSLHATRSLVSSRRPPGATAFRPPSMASTDADEDQLLKSFLAEVSEAERDNEVLRILGCFKLNPFEHLKLSFDSSADEVKKQYRKLSLLVHPDKCKHPKAQEAFAALAKAQQLLLDPQERGYILDQVTAAKEELRAKRKKELKKDSASKIKSQVDEGKYEEQYERSEEFQKQLIIKVREILTDKEWRRRKMQMRISEEEGRLKKDEEETKEMWKKKREHEEKWEETRDQRVSSWRDFMKTGKKARKGEIKPPKLKTEDPNKSYVQRPVKRA

SEQ ID NO: 223 - protein, 246 aa, Oryza sativa
MASTDADEDQLLKSFLAEVSEAERDNEVLRILGCFKLNPFEHLKLSFDSSADEVKKQYRKLSLLVHPDKCKHPKAQEAFAALAKAQQLLLDPQERGYILDQVTAAKEELRAKRKKELKKDSASKIKSQVDEGKYEEQYERSEEFQKQLIIKVREILTDKEWRRRKMQMRISEEEGRLKKDEEETKEMWKKKREHEEKWEETRDQRVSSWRDFMKTGKKARKGEIKPPKLKTEDPNKSYVQRPVKRA

SEQ ID NO: 224 - protein, 198 aa, Glycine max
MWKRTGFEEEAVQLINSDFRDLSLAANRLAHHAIKLGGIGFGASFFGLFAAIAAIYLLILDRTNWKTNILTALLIPYIFFSLPSLIFDVFRGELGKWIAAVAVVLRLFLPRHFPDWLELPGALILLIVVAPSLIASTFRDNIVGVVVCLIIACYLLQEHIRASGGFRNSFTKAHGISNSIGIILLLVYPIWALVVILF

SEQ ID NO: 225 - protein, 622 aa, Hordeum vulgare
  misc_feature (386)..(386): Xaa can be any naturally occurring amino acid
PQPNIYKSPPIFAGALTMATKNYGELYNMLGWGEPYFIVNTDGHLCVKTNGHETKPGQEIDVVSVVEAAKEEGVQFPMILRFPGVLKHRVDSLHVAFENAIKHTGYTAPYQGVYPVKVNQNKAIINDFVTFGHRYSYGLEAGSKPELLIAMSYLTKAKPGAFLVCNGYKDAEYVALALSARAMGLNVIIVLEMEEELDIVIDQSNKLGVEPVLGVRAKLLTKIPGHFGSTAGKHGKFGLLAEKIYEVAKKLQGLNKLHWLKLLHFHIGSMIPTTDIVSNAAREASGIYCTLVNQYGAQMTTLDCGGGLGVDYDGTRSGSSDMSVAYGLEEYASSIVQAVRLTCEYNGGVPHPVLCTESGRAMVSHHSMIILEALSAIPEPKDDDTXEQLHGKIQHLSSNVPSPRALVATDLQKHATDIQKHGIEMYKLAKKLSKRIAGDANTIYNYHMNLSIFSLVPDFWGIKHLFPMMPASRLNEKPTQMGTLIDITCDSDGKVDKFIGNADTLPLHTLDPESDGYYVAVLLSGAYQEALSCKHNLFGGPSIVRVENNTDGGGGFHIATADLGPTTEELISTVGYDVKEDIRGVIEKWAREKEVWEKVGVFVEAGLTSMPYLVEYKVPRTA

SEQ ID NO: 226 - protein, 605 aa, Hordeum vulgare
MATKNYGELYNMLGWGEPYFIVNTDGHLCVKTNGHETKPGQEIDVVSVVEAAKEEGVQFPMILRFPGVLKHRVDSLHVAFENAIKHTGYTAPYQGVYPVKVNQNKAIINDFVTFGHRYSYGLEAGSKPELLIAMSYLTKAKPGAFLVCNGYKDAEYVALALSARAMGLNVIIVLEMEEELDIVIDQSNKLGVEPVLGVRAKLLTKIPGHFGSTAGKHGKFGLLAEKIYEVAKKLQGLNKLHWLKLLHFHIGSMIPTTDIVSNAAREASGIYCTLVNQYGAQMTTLDCGGGLGVDYDGTRSGSSDMSVAYGLEEYASSIVQAVRLTCEYNGGVPHPVLCTESGRAMVSHHSMIILEALSAIPEPKDDDTPEQLHGKIQHLSSNVPSPRALVATDLQKHATDIQKHGIEMYKLAKKLSKRIAGDANTIYNYHMNLSIFSLVPDFWGIKHLFPMMPASRLNEKPTQMGTLIDITCDSDGKVDKFIGNADTLPLHTLDPESDGYYVAVLLSGAYQEALSCKHNLFGGPSIVRVENNTDGGGGFHIATADLGPTTEELISTVGYDVKEDIRGVIEKWAREKEVWEKVGVFVEAGLTSMPYLVEYKVPRTA

SEQ ID NO: 227 - protein, 267 aa, Sorghum bicolor
HEGGAEVANYCRERLQVLLRQELRLLGKDLGETSEVEMKEHWDDLFTRCFQRLDDEVSGQASRLVGGVQESRPVAAENVGSTAVVAVVCSSHVVVANCGDSRVVLCRGKEPVELSIDHKPDRKDERARIEALGGKVIQWNGYRVSGILAMSRSIGDRYLKPFVIPKPEVTVFPRAKDDDCLILASDGLWDVIPNEEACKVARRQIQLWHKNNGVASSLCDEGDESTDPAAQAAADYLMRLALKKGTEDNITVIVVDLKPRKKLKSNS

SEQ ID NO: 228 - protein, 380 aa, Sorghum bicolor
MAATAAICVEDEATCAAAECAPGVEKLDLAAAGAGADGKAGGSKRSVYLMDCAPVWGCASTRGRSAEMEDACAAFPRFADVPVRLLARRRDLDGLGLDADALRLPAHLFGVFDGHGGAEVANYCRERLQVLLRQELRLLGKDLGETSEVEMKEHWDDLFTRCFQRLDDEVSGQASRLVGGVQESRPVAAENVGSTAVVAVVCSSHVVVANCGDSRVVLCRGKEPVELSIDHKPDRKDERARIEALGGKVIQWNGYRVSGILAMSRSIGDRYLKPFVIPKPEVTVFPRAKDDDCLILASDGLWDVIPNEEACKVARRQIQLWHKNNGVASSLCDEGDESTDPAAQAAADYLMRLALKKGTEDNITVIVVDLKPRKKLKSNS

SEQ ID NO: 229 - protein, 501 aa, Arabidopsis thaliana
MNSESLENLHRPLIESSKSFVDYRLETVLTDRELPYFRRIYLAMMIEMKFLFHLAAPAIFVYVINNGMSILTRIFAGHVGSFELAAASLGNSGFNMFTYGLLLGMGSAVETLCGQAHGAHRYEMLGVYLQRSTVVLILTCLPMSFLFLFSNPILTALGEPEQVATLASVFVYGMIPVIFAYAVNFPIQKFLQSQSIVTPSAYISAATLVIHLILSWIAVYRLGYGLLALSLIHSFSWWIIVVAQIVYIKMSPRCRRTWEGFSWKAFEGLWDFFRLSAASAVMLCLESWYSQILVLLAGLLKNPELALDSLAICMSISAISFMVSVGFNAAASVRVSNELGAGNPRAAAFSTVVTTGVSFLLSVFEAIVVLSWRHVISYAFTDSPAVAEAVADLSPFLAITIVLNGIQPVLSGVAVGCGWQAFVAYVNIGCYYVVGIPVGFVLGFTYDMGAKGIWTGMIGGTLMQTIILVIVTLRTDWDKEVEKASSRLDQWEESREPLLKQ

SEQ ID NO: 230 - protein, 501 aa, Arabidopsis thaliana; identical to SEQ ID NO: 229

SEQ ID NO: 231 - protein, 637 aa, Oryza sativa
MARRAPWLAGIGAVPFLIVVVVAVVGAAVPAMGRFVVEKSSVRVLSPEHIRGHHDAAIGNFGVPDYGGTLTGVVVYPDKKATGCAEFDAKFKSKSRRPVILLLDRGECYFALKAWNAQQAGAAAVLIADNVDEQLLTMDTPEESPETEYIDRISIPSALVNRAFGESLKRMSSPSPSSEAAVEVVVKLDWRESMPHPDERVEYELWTNSNDECGARCDEQMEFVRGFRGHAQIMERGGYALFTPHYITWYCPEAFKLTQQCKSQCINHGRYCAPDPEQDFGEGYEGKDVVVENLRQLCVHRVANETGRPWAWWDYVMDYKIRCSMKEKKYSKGCAEDVVKALGLSLDKVLECMGDPEADTDNAVLAKEQEDQIGRGSRGDVTILPTLVINNVQYRGKLERTAVLKAVCAGFKEGTEPRVCLSNDIETNECLHRNGGCWRDEKTNVTACKDTFRGRVCECPVVNGVQYEGDGYIGCKAVGPGRCTVDNGGCWSETRGHQTFSACSDTALTGCRCPPGFQGDGHKCEDLDECKEKLACTCPNCHCKNTWGNYECKCKGNQIYIRGEDTCIANSMSRFGWFITILVASCVAGVGIAGYVFYKYRLRSYMDSEIMAIMSQYMPLDSQNNENQPLRQHDSEA

SEQ ID NO: 232 - protein, 637 aa, Oryza sativa; identical to SEQ ID NO: 231

SEQ ID NO: 233 - protein, 638 aa, Solanum lycopersicum
MLVPLHSPANMAALFFRLLFFSLIVSNVVLVQARFIVEKNSISVLSPYSMHSKHDASIGNFGVPDYGGSLVGTVVYPSKGANGCAEFDGDKPFKSKGHRPNILLLDRGDCYFALKVWNGQQAGAAAVLVADSIDEALITMDSPEESTDANGYIEKIGIPSALIEKSFGDALKEALKKGEEVVIKMDWTESMPHPDQRVEYELWTNSNDECGVRCDEQMNFIKNFKGHAQILEKGGYTMFTPHYITWYCPEAFILSSQCKSQCINHGRYCAPDPEQDFGEGYQGKDVVFENLRQLCVHRVANESSRSWVWWDYVTDFHIRCSMKQKRYSKECAEEVMKSLDLPVDKIKKCMGDPEANVENDVLKTEQDLQVGRGPRGDVTILPTMVINDIQYRGKLERTAVLKAICAGFKETTEPSICLSGDLETNQCLERNGGCWRDPKSNITACKDTYRGRVCECPLVNGVQYKGDGYTSCEAVGPGRCSVNNGGCWSETRNGQTYSACSEGELSGCKCPYGFKGDGHKCEDVDECKEGLVCQCDGCSCKDTWGGFECKCKGNQLYIMEHDTCIERHSSKIGRVLMFSFLAIAVGAGLAGYTFYKYRLRSYMDSEIMAIMSQYMPLDNHNQNQVVHHEAEPLQQSSV

SEQ ID NO: 234 - protein, 628 aa, Solanum lycopersicum
MAALFFRLLFFSLIVSNVVLVQARFIVEKNSISVLSPYSMHSKHDASIGNFGVPDYGGSLVGTVVYPSKGANGCAEFDGDKPFKSKGHRPNILLLDRGDCYFALKVWNGQQAGAAAVLVADSIDEALITMDSPEESTDANGYIEKIGIPSALIEKSFGDALKEALKKGEEVVIKMDWTESMPHPDQRVEYELWTNSNDECGVRCDEQMNFIKNFKGHAQILEKGGYTMFTPHYITWYCPEAFILSSQCKSQCINHGRYCAPDPEQDFGEGYQGKDVVFENLRQLCVHRVANESSRSWVWWDYVTDFHIRCSMKQKRYSKECAEEVMKSLDLPVDKIKKCMGDPEANVENDVLKTEQDLQVGRGPRGDVTILPTMVINDIQYRGKLERTAVLKAICAGFKETTEPSICLSGDLETNQCLERNGGCWRDPKSNITACKDTYRGRVCECPLVNGVQYKGDGYTSCEAVGPGRCSVNNGGCWSETRNGQTYSACSEGELSGCKCPYGFKGDGHKCEDVDECKEGLVCQCDGCSCKDTWGGFECKCKGNQLYIMEHDTCIERHSSKIGRVLMFSFLAIAVGAGLAGYTFYKYRLRSYMDSEIMAIMSQYMPLDNHNQNQVVHHEAEPLQQSSV

SEQ ID NO: 235 - protein, 81 aa, Oryza sativa
MKLLPLLILAMVMANAFGAVTSRTAPGEEALLAHGVVKTTTAEGTSIDNHHAIPRPEYDSWSSPGNMPGSGHDIGSEQAQP

SEQ ID NO: 236 - protein, 271 aa, Oryza sativa
MKIQCDACESAAAAVVCCADEAALCAACDVEVHAANKLAGKHQRLPLEALSARLPRCDVCQEKAAFIFCVEDRALFCRDCDEPIHVPGTLSGNHQRYLATGIRVGFASASPCDGGSDAHDSDHHAPPMGSSEHHHHHQQPAPTVAVDTPSPQFLPQGWAVDELLQFSDYETGDKLQKESSPPLGFQELEWFADIDLFHNQAPKGGAAAGRTTAEVPELFASQAANDVAYYRPPTRTAAAAFTAATGFRQSKKARVELPDDEEDYLIVPDLG

SEQ ID NO: 237 - protein, 437 aa, Arabidopsis thaliana
MGRKSQRKNATMFDSDDDTSSVSSSSTMPSERLLNPGMDEVTVLKDALLDQSLDALYEKREQALATIVDAFNSDLQYEFVEKKFATLLHQCLHCTKKGSTKETSLATHVIGLLALTVGLGDHAQEVLEESVTPLSQALKSGREILKITSILECLAVITFVGGNDPEQTEKSMQIIWQMIHPKLGSNVVATKPSPAVISAVVSSWAFLLTTVDRWTLGPKIFQETVTYLSTLLEKDDRSVRIAAGEALAVIYELGTLEKFAAEVKGSANGSVKEGGVSQEALMHMHGLKAKVTKQVRELSVEAGGKGSAKKDLNTQRNLFKDLVEFLEDGYAPETSTKVGGDYLQTSTWYQMIQLNYLKHFLGGGFIKHMQENEFLHDVFSFTPKKIGGGKLSNDEKRLFKSPNSALNKARTQFLAKQRMLAKNMNVGHYAATAMEEE

SEQ ID NO: 238 - protein, 437 aa, Arabidopsis thaliana; identical to SEQ ID NO: 237

SEQ ID NO: 239 - protein, 345 aa, Oryza sativa
MAATNKKIVLRNHVTGFPKESDMELVAATGAAPSRVPEGTDGAVLVKNLYLSCDPYMRGRMSSHDGSYVDAFVVGEAITGYGVGKVVDSSHPGFKAGDLVWGMTGWEEYSLIKDPSRALFAIRHPDLPLSYYTGLLGMAGFTAYVGFHEICAPREGERVYVSAASGAVGQLVGQFAKLMGCYVVGSAGSDDKVRLLREKFGFDDAFNYKKESDLSAALKRCFPEGIDIYFENVGGAMLDAVLLNMRVRGRVAACGMISQYNLEHPDPVHNLTAIVTKRLRIEGFIVSDHYARYREYEEKAARYVKEGKIAYVEDVAEGLENAPAALIGLFSGRNVGKQVVVVARE

SEQ ID NO: 240 - protein, 517 aa, Arabidopsis thaliana
MGVVSISSSAARSPLGLGNDLLTHRSSLKKPSIVAFKADDSSNSALIIPPREQVLIPAEKHNEKKREVTRRKPCKTPKKPLSLEHNSAPSCSLGVDYNEAAARLESIYKLSPATTTLVEDDVEDGGSKAKVSRRRKRKESGEEKKVVVRNNVKKEKRMSLDKRIALKRNVQEKPVVASVDKKVTKRQQEEEKIERLVRDYSASNDIVSLDWKKMKIPPVLSSTEHAWLFKLMQPMKALLEVKDVLQKSLGREPREAEIAGEINMTAGEVKKKIEIGRAARNKLIKHNLRLVLFVMNKYFHEFTNGPKFQDLCQAGMRGLITAIDRFEPKRKFRLSTYGLFWIRHAIIRSMTTSNFTRVPFGLESVRVEIYKAKTELWFEMGRPPTEDEVVERLKITPERYREVLRAAKPVLSLNSKHSVTQEEFINGITDVDGVGANNSRQPALLRLALDDVLDSLKPKESLVIRQRYGLDGKGDRTLGEIAGNLNISREMVRKHEVKALMKLKHQARVDYLRQYIV

SEQ ID NO: 241 - protein, 205 aa, Oryza sativa
MAARLLLLVLFAVVAARVGAAAAYQPGSAEGHTIAGRIKIDAASAIAKGFGLPAKTSNTKVILNGGQRVTFARPDGYFAFHNVPAGTHLIEVSSLGYLFSPVRVDISARNPGHIQAALTENRRVLNELVLEPLREEQYYEKREPFSIMSLLKSPMGMMLGFMVIMVFVMPKMMENIDPEEIKQAQEQMRNSPVPSFSGLLARANS

SEQ ID NO: 242 - protein, 888 aa, Arabidopsis thaliana
MEKKKVWFWGVKDDGEGGGGRGGGRTKDAEDDVADHLSRDGTMSQYSLSKGLLPSLGANNRSSRDVILPRFIVSPFDPRYRAWETFLVFLVLYTAWASPFEFGFLQKPRPPLSILDNIVNGFFAVDIVLTFFVAFLDKVTYLLVDDPKRIAWRYASTWLIFDVVSTFPYEIFGSLLHESIQGYGIFSMLRLWRLRRVSNCFARLEKDRKYSYFWVRCSKLLLVTLFVIHCGACFLYSIAAHYPDPSKTFMALTDENWKESPIAVRYNTAMYWSITTFSTTGYGDIHGVNSREMTFILFYMVFNLGLSAYIIGNMTNLVVHVTGRTRKFRDTIQAASGFGQRNNLPVRLQDQMVAHLCLRYRTDSEGLQQQEIIDSLPKAIRSSISHYLFYEVVDKIYLFHGISNDLLFQLVTEMKAEYFPPKEDVILQNEAPTDFYILVTGAVDIIARVNGVEQVVSEAQRGHVFGEVGVLCYRPQLFTVRTKRLSQLLRLNRTVLLNLVQANVGDGAIIMNNLLQHLKDSEDPVMKGVLADTEHMLAQGKMDLPLSLCFAAARGDDLLLHQLLRRGSSPNEMDKDGRTALHIAASKGSHYCVVLLLEHGADPNIRDSEGNVPLWEAIIGRHREIAKLLAENGAKLSLDSVSYFSGLAVEKNCLDALKDIIKYGGDVTLPDGNGTTALHRAVSEGHLEIVKFLLDQGADLDWPDSYGWTPRGLADHQGNEEIKTLFHNHRPVEKKPKPIPGIPQSPVTGKPLMKYSSEPTMHSGELVLDGGQVVVSQKRKLNNFRNSLFGIISAANSADDGGEVPRSPAVPGGGGSMIYPERVTISSPENGETGGKVVLLPNSMEELLKIGENKMGFVPTKVLTREGAEIDDITLIRDGDFLLLSRDP

SEQ ID NO: 243 - protein, 888 aa, Arabidopsis thaliana
MEKKKVWFWGVKDDGEGGGGRGGGRTKDAEDDVADHLSRDGTMSQYSLSKGLLPSLGANNRSSRDVILPRFIVSPFDPRYRAWETFLVFLVLYTAWASPFEFGFLQKPRPPLSILDNIVNGFFAVDIVLTFFVAFLDKVTYLLVDDPKRIAWRYASTWLIFDVVSTFPYEIFGSLLHESIQGYGIFSMLRLWRLRRVSNCFARLEKDRKYSYFWVRCSKLLLVTLFVIHCGACFLYSIAAHYPDPSKTFMALTDENWKESPIAVRYNTAMYWSITTFSTTGYGDIHGVNSREMTFILFYMVFNLGLSAYIIGNMTNLVVHVTGRTRKFRDTIQAASGFGQRNNLPVRLQDQMVAHLCLRYRTDSEGLQQQEIIDSLPKAIRSSISHYLFYEVVDKIYLFHGISNDLLFQLVTEMKAEYFPPKEDVILQNEAPTDFYILVTGAVDIIARVNGVEQAISEAQRGHVFGEVGVLCYRPQLFTVRTKRLSQLLRLNRTVLLNLVQANVGDGAIIMNNLLQHLKDSEDPVMKGVLADTEHMLAQGKMDLPLSLCFAAARGDDLLLHQLLRRGSSPNEMDKDGRTALHIAASKGSHYCVVLLLEHGADPNIRDSEGNVPLWEAIIGRHREIAKLLAENGAKLSLDSVSYFSGLAVEKNCLDALKDIIKYGGDVTLPDGNGTTALHRAVSEGHLEIVKFLLDQGADLDWPDSYGWTPRGLADHQGNEEIKTLFHNHRPVEKKPKPIPGIPQSPVTGKPLMKYSSEPTMHSGELVLDGGQVVVSQKRKLNNFRNSLFGIISAANSADDGGEVPRSPAVPGGGGSMIYPERVTISSPENGETGGKVVLLPNSMEELLKIGENKMGFVPTKVLTREGAEIDDITLIRDGDFLLLSRDP

SEQ ID NO: 244 - protein, 782 aa, Arabidopsis thaliana
MEIESGSYQNAKKESWRTVLTLAYQSLGVVYGDLSISPLYVYKSTFAEDIHHSESNEEIFGVLSFIFWTITLVPLLKYVFIVLRADDNGEGGTFALYSLLCRHARVNSLPSCQLADEQLIEYKTDSIGSSSMPQSGFAASLKSTLEKHGVLQKILLVLALIGTCMVIGDGVLTPAISVFSAVSGVELSMSKEHHKYIELPAACVILIGLFALQHYGTHRVGFLFAPVILLWLMCISAIGVYNIFHWNPHVYQALSPYYMYKFLKKTQSRGWMSLGGILLCITGSEAMFADLGHFSQLSIKIAFTSLVYPSLILAYMGQAAYLSQHHIIESEYNIGFYVSVPERLRWPVLVIAILAAVVGSQAIITGTFSIIKQCSALGCFPKVKIVHTSSKIHGQIYIPEINWILMVLCLAVTIGFRDTKRLGNASGLAVITVMLVTTCLMSLVIVLCWHKSVIFAIVFVVFFGTIESLYFSASLIKFLEGAWVPIALAFCFLLAMCTWHYGTLKRYEYDVQNKVSVNWLLSLSQTLGIARVRGLGLIHTELVSGVPAIFSHFVTNLPAFHQVLVFLCVKSVPVPHVRPQERFLVGRIGPKEFRIYRCIVRFGYRDVHKDDFEFEGDLVCSIAEFIRTEAETAATAAETNGEDDDRMSVVGTCSTYMQGIEDHYESDIDDPDKPGTSEIRSPKPKKKSKSKVKKRVRFVVPETPKIEKETRQELMELTEAREGGVAYIMGNAYMKAKPGSGLLKRLAINIGYEFLRRNTRGPRNMLTSPHASTLEVGMIYNV

SEQ ID NO: 245 - protein, 721 aa, Glycine max
  misc_feature (380)..(380): Xaa can be any naturally occurring amino acid
  misc_feature (385)..(385): Xaa can be any naturally occurring amino acid
  misc_feature (398)..(398): Xaa can be any naturally occurring amino acid
  misc_feature (410)..(410): Xaa can be any naturally occurring amino acid
  misc_feature (415)..(415): Xaa can be any naturally occurring amino acid
  misc_feature (423)..(423): Xaa can be any naturally occurring amino acid
  misc_feature (437)..(437): Xaa can be any naturally occurring amino acid
VYGDIGTSPLYVYASTFTKKINNNDDILGVLSLIIYTIVLIPFLKYVFIVLWANDNGNGGAFALYSLICRHIKMSLIPNQEPEDRELSNYKLETPSTEFKRAQKLKQKLEGSHVARVVLILLAIVGTSMVIGDGILTPSISVLSAVSGISTSLGQDAVVGITIAILAVLFYVQRFGTDKVGFAFAPIILVWFLFIGGIGLYNLFKYDIGVLRAFNPKYIYDYFKRNGKEGWISLGGVFLCITGSEAMFADLGHFNVRSIQISFSCITFPAIVAAYIGQAAFLRKFPEKVANTFYDSIPDPLYWPTFVVAVAAAIIASQAMISGAFSIISQALSLGCFPRVRVVHTSIKHQGQVYIPEVNYMFMIACIVVCAAFKTTEKIXHAYGXAVIGDMMITTTLXSLIMLVLWKKSXWRVGXFFLGFGFXEIVYFSSQLTKFTXGGYLPIVSAMFLTAVMGIWHYVHKERYMFELKNKVSSAYLNELANNPDVRRVPGIGLLYSELVQGIPPIFQHLIDNIPSIHSIIVFVSIKAIPVSRVASEERFLFRQVEPRDYRVFRCVVRHGYNDVLEDPAEFESHLIQNLKAFVQHENYMLEVDGTEHASAETEMIAAVGKGSSNRIIPDQAAASSDSIRSLGASATKSSSFISPPIQGAEDEIKFIDKALEKGVVYMLAEAEVVAHPSSSILNKIVVNYVYSFFRKNFRQGQNSMAIQRNRLLKVGMTYEI

SEQ ID NO: 246 - protein, 796 aa, Glycine max
MSGEADRTSIEEEMDTGKETAEKNLKLKDRKVSWAKLRRVDSLNLEAGRVSTVAHNPYQMGWRTTLILAFQSIGVVYGDIGTSPLYVYASTFTKKINNNDDILGVLSLIIYTIVLIPLLKYVFIVLWANDNGNGGAFALYSLICRHIKMSLIPNQEPEDRELSNYKLETPSTEFKRAQKLKQKLEGSHVARVVLILLAIVGTSMVIGDGILTPSISVLSAVSGISTSLGQDAVVGITIAILAVLFYVQRFGTDKVGFAFAPIILVWFLFIGGIGLYNLFKYDIGVLRAFNPKYIYDYFKRNGKEGWISLGGVFLCITGSEAMFADLGHFNVRSIQISFSCITFPAIVAAYIGQAAFLRKFPEKVANTFYDSIPDPLYWPTFVVAVAAAIIASQAMISGAFSIISQALSLGCFPRVRVVHTSIKHQGQVYIPEVNYMFMIACIVVCAAFKTTEKISHAYGIAVIGDMMITTTLVSLIMLVLWKKSLWRVGLFFLGFGFVEIVYFSSQLTKFTGGGYLPIVSAMFLTAVMGIWHYVHKERYMFELKNKVSSAYLNELANNPDVRRVPGIGLLYSELVQGIPPIFQHLIDNIPSIHSIIVFVSIKAIPVSRVASEERFLFRQVEPRDYRVFRCVVRHGYNDVLEDPAEFESHLIQNLKAFVQHENYMLEVDGTEHASAETEMIAAVGKGSSNRIIPDQAAASSDSIRSLGASATKSSSFISPPIQGAEDEIKFIDKALEKGVVYMLAEAEVVAHPSSSILNKIVVNYVYSFFRKNFRQGQNSMAIQRNRLLKVGMTYEI

SEQ ID NO: 247 - protein, 205 aa, Oryza sativa
MGSASRAVSCLCCPCKCLACGLFSCLCSILISLLVTLGVLALIFYLIFRPHMIAATVDSAALTQFTLSTNSALAYSLTVDLTVRNPNKRVGLYYDNVESLALFDGQRFGYAPLDSFYQSTEASTKLSPAFKGQQPLQGDITAANFRSQQTAGKFDIEVKLNAKLRVKVWAFKVPGPKAKISCPITVPASAPNAPAFQRTDCKVWF

SEQ ID NO: 248 - protein, 250 aa, Zea mays
MESLFGQSQRRRRAGGSGFESLKRLGHISPAVQSHLKHVYLTLCSALAFSALGAYLHILLNVGGALTTVGCVASIAFLISLPASRDQERNRLALLMSAALLQGASVGPLVDLVIDLDSRILVTAFVGTAVAFACFSGAAIIAKRREYLYLGGLLSSGLSILLWLQFATSIFGHTSATFMFELYFGLLVFLGYMVFDTQEIIERAHRGDMDYIKHALTLFTDFVAVLVRILVIMMKNAQEKSQDEKKRKKR

SEQ ID NO: 249 - protein, 250 aa, Zea mays; identical to SEQ ID NO: 248

SEQ ID NO: 250 - protein, 250 aa, Hordeum vulgare
LVPNSARPIPSPPLSRRRISLSSSPPPQSPSPSRTSSSSSRDEMGSGSRAASCLCCPFKCLACGLFSCLCSILVSLIVTAGVLALILYFIFRPQMIAATVDSASLTQFALGPANPALLQYNLSVDMTVRNPNKRVGLYYDRVEALALFDGQRFGFAPLDPFFQGHQASTDLKPAFGGQHVLDGDVTQSNLRTQLAAGAVEVEVKLNAKLRVKVWAFKVPGPRARISCPLSIPAPGGAAPAFKPTDCKVWF

SEQ ID NO: 251 - protein, 252 aa, Hordeum vulgare
PPQITQIQPPIPSPPLSRRRISLSSSPPPQSPSPSRTSSSSSRDEMGSGSRAASCLCCPFKCLACGLFSCLCSILVSLIVTAGVLALILYFIFRPQMIAATVDSASLTQFALGPANPALLQYNLSVDMTVRNPNKRVGLYYDRVEALALFDGQRFGFAPLDPFFQGHQASTDLKPAFGGQHVLDGDVTQSNLRTQLAAGAVEVEVKLNAKLRVKVWAFKVPGPRARISCPLSIPAPGGAAPAFKPTDCKVWF

SEQ ID NO: 252 - protein, 478 aa, Arabidopsis thaliana
MSVSTHHHHVVLFPFMSKGHIIPLLQFGRLLLRHHRKEPTITVTVFTTPKNQPFISDFLSDTPEIKVISLPFPENITGIPPGVENTEKLPSMSLFVPFTRATKLLQPFFEETLKTLPKVSFMVSDGFLWWTSESAAKFNIPRFVSYGMNSYSAAVSISVFKHELFTEPESKSDTEPVTVPDFPWIKVKKCDFDHGTTEPEESGAALELSMDQIKSTTTSHGFLVNSFYELESAFVDYNNNSGDKPKSWCVGPLCLTDPPKQGSAKPAWIHWLDQKREEGRPVLYVAFGTQAEISNKQLMELAFGLEDSKVNFLWVTRKDVEEIIGEGFNDRIRESGMIVRDWVDQWEILSHESVKGFLSHCGWNSAQESICVGVPLLAWPMMAEQPLNAKMVVEEIKVGVRVETEDGSVKGFVTREELSGKIKELMEGETGKTARKNVKEYSKMAKAALVEGTGSSWKNLDMILKELCKSRDSNGASE

SEQ ID NO: 253 - protein, 478 aa, Arabidopsis thaliana; identical to SEQ ID NO: 252

SEQ ID NO: 254 - protein, 453 aa, Arabidopsis thaliana
MGGLKFHVLMYPWFATGHMTPFLFLANKLAEKGHTVTFLLPKKSLKQLEHFNLFPHNIVFRSVTVPHVDGLPVGTETASEIPVTSTDLLMSAMDLTRDQVEAVVRAVEPDLIFFDFAHWIPEVARDFGLKTVKYVVVSASTIASMLVPGGELGVPPPGYPSSKVLLRKQDAYTMKKLEPTNTIDVGPNLLERVTTSLMNSDVIAIRTAREIEGNFCDYIEKHCRKKVLLTGPVFPEPDKTRELEERWVKWLSGYEPDSVVFCALGSQVILEKDQFQELCLGMELTGSPFLVAVKPPRGSSTIQEALPEGFEERVKGRGLVWGGWVQQPLILSHPSVGCFVSHCGFGSMWESLLSDCQIVLVPQLGDQVLNTRLLSDELKVSVEVAREETGWFSKESLCDAVNSVMKRDSELGNLVRKNHTKWRETVASPGLMTGYVDAFVESLQDLVSGTTHD

SEQ ID NO: 255 - protein, 453 aa, Arabidopsis thaliana; identical to SEQ ID NO: 254

SEQ ID NO: 256 - protein, 273 aa, Solanum lycopersicum
MSFQDLEAGRPLGPRRGYMNGKQDPTQAVASGIFQINTAVSTFQRLVNTLGTPKDTPELREKLHKTRVHIGQLVKDTSAKLKQASETDHRVEVSASKKITDAKLAKDFQAVLKEFQKAQRLAAERETAYTPFVPQAVLPSSYTASEIDVSSGKSPEQRALLVESRRQEVLLLDNEIAFNEAIIEEREQGIQEIQQQIGEVNEIFKDLAVLVHEQGAMIDDIGSNVENAHAATAQGRSQLAKAAKTQRSNSSLTCLLLVIFGIVLLIVIVVLAA

SEQ ID NO: 257 - protein, 588 aa, Triticum aestivum
  misc_feature (167)..(167): Xaa can be any naturally occurring amino acid
  misc_feature (364)..(364): Xaa can be any naturally occurring amino acid
MSEQPLPQPRSSMREALQKEDKEKASAAAPPAKEKAAVPPPPVAAPPMAKNGGGGGKGGNGAQPPAAEETTREIQVVREAYRQPAAPAYVMPEEPPAMVELVGWYLYGFCSFFITHLLLPVLFPAIVTQVAFPSSDFTPEAKYTVKGASCSVHEMSMYQRLTRYTIXISSSHMSPLGWSALSWAIGILLVAPLLTQVAHHLDRGQYQSLILIAATSFGSFFCLLTGFFKTVWVFLFYILFIAASIIIAEAVHTRNLGLMIRGLAAHDSGKHLVLRRRAAASQLSLYCTAIGGIGAALMAAFMYHMLRRTDQLTGLWVVSIFSGLIWFIGICHGLFTNRPSSSSPTTAFEPNFISKLKYSMTIGXYPQAIGSLVAVFLSSFATMCIFTSGTLYAIGGVCIKPVLVLALWILYFLFPLISLPLLHPIQIIIRADAVRMQLLGFIIALFVSGAGFYFKSHRWRAAHIIIIALVQSTANGILYSFGRILLLDASPPGKEGAFAIWYAYVRCMGAMIGFAVASAGPGRAGGSFAAAFLGSFLGIIVLIFGNVSNIGALKAAGHLKGMEDDKRIGEKGEGMSAVADSGESRGRV

SEQ ID NO: 258 - protein, 588 aa, Triticum aestivum
MSEQPLPQPRSSMREALQKEDKEKASAAAPPAKEKAAVPPPPVAAPPMAKNGGGGGKGGNGAQPPAAEETTREIQVVREAYRQPAAPAYVMPEEPPAMVELVGWYLYGFCSFFITHLLLPVLFPAIVTQVAFPSSDFTPEAKYTVKGASCSVHEMSMYQRLTRYTIDISSSHMSPLGWSALSWAIGILLVAPLLTQVAHHLDRGQYQSLILIAATSFGSFFCLLTGFFKTVWVFLFYILFIAASIIIAEAVHTRNLGLMIRGLAAHDSGKHLVLRRRAAASQLSLYCTAIGGIGAALMAAFMYHMLRRTDQLTGLWVVSIFSGLIWFIGICHGLFTNRPSSSSPTTAFEPNFISKLKYSMTIGHYPQAIGSLVAVFLSSFATMCIFTSGTLYAIGGVCIKPVLVLALWILYFLFPLISLPLLHPIQIIIRADAVRMQLLGFIIALFVSGAGFYFKSHRWRAAHIIIIALVQSTANGILYSFGRILLLDASPPGKEGAFAIWYAYVRCMGAMIGFAVASAGPGRAGGSFAAAFLGSFLGIIVLIFGNVSNIGALKAAGHLKGMEDDKRIGEKGEGMSAVADSGESRGRV

SEQ ID NO: 259 - protein, 428 aa, Hordeum vulgare
MCSSRRRGDRQLQLLHRLLALSSLLLLASGEVIFEERFEDGWETRWVKSDWKRSEGKAGTFKHTAGKYSGDPDDKGIQTTIDARHFAISAKIPEFSNKGRTLVVQYSIKFEQEIECGGGYIKLMSGYVNQKKYSGDTPYSLMFGPDICGTQTKKLHLILSYQGQNYPIKKDLQCETDRLTHVYTFILRPDASYSLLVDNRERESGSMYTDWDILPPRKIKDVGAKKPKDWDDREYIEDPDAVKPEGYDSIPREIPDPKDKKPDTWDDDDDGIWKPRRIPNPAYKGQWKRKKIKNPNYKGKWKIPWIDNPEFEDDPDLYVLKPLKYIGIEVWQVKAGSVFDNILICDDPEYAKQVADETWGANKEAEKEAFEEAEKERKAREDKEAQQAREEGERRRRERGDRHRGRDHYKDRYKRRNRDHWDDYHDEL

SEQ ID NO: 260 - protein, 428 aa, Hordeum vulgare; identical to SEQ ID NO: 259

SEQ ID NO: 261 - protein, 1121 aa, Oryza sativa
MVVREPVAMEIPAVESSAAGRMPPRIRRRLLEGSRVGGGAPTSAEEIEAKLKEAELRRQQFHEWVSCKARKKPRSPSWSSQEEDQGQRLEAKLQAAEQKRLSLLAKAQNRLAKLDELRQAAKNIVEMRIEKEREELGTRVESRVRQAEANRMRLLHAHMQKRAAMKERTARSLVRKQTSERKYTERVKSLILQKRNAAEKKRLALLEAEKRKAQARILHIQRAAKTVCSKRESERRQLQEQLESKLQKAKRQRAEYLKQRVSPRSSAHADYIKHAEFLSTKLARCWKRFLKSNKTTYALVQAYDALGINEMSVKSMPFENLAMLMESPTTLQTTKAVLDRFEKRLLLSQPTGSSSAENIDHLLKRLGSPKRKAPASRSRVAAKKPAKGSETSKLSRYSLRVVLCSYMILAHPGAVLSGQGEKENLLMESAENFVKEFELLVKTVLDRPGGASMQSTDAASQKKFRTQLAAFDKAWCAYLYHFVVWKLKDAKSLEQDLVRAACKLELSMMQTCKLSSDGQSHDLSHDMKAIQKQVTDDQKLLREKIQHLSGDAGIERMNSALSDTRSKFFEAKENGNPLATSVANVSTPLSINSSGQVPNPTSKPTVEGSSFTAQSLPGAASSSSSTSPMKPPTDNEQMVNEMLHEDDVSFARNSDNVSSAEKDFQAKVKATMEKAFWDLVTDSMRGDKPDYSQLINLVKEVRNSLHELASNELKEEILENIDLEILSQVLQSGSQDTRYLGQILQYSLDMVRKLSAPAKEDDMKRSHEKLLNELAASSEVNDNGISSFVIAVIKGLRFTLEEIKQLQTEVSKARIQLMQPIIKGSAGVEYLQKAFTDRYGPPANASVSLPITKQWVSATKSIVEQEWSSHLESLQALPADHAQHVVPVLRAGHGAPAPQASSSAASSSGLPECKGEKIDKLTRVGLLQLISNVEGLNMQSTPETFQINLLRLRAVQDQFQKVIVIATSMLVLHQVLMLKIAPPELQNTISELYDALVKLLDNNADASTKEIVEAMTRSLASVGSLPEEQIQDTTELATKMLLKSLQAGDIVFGKVSRAVYFAFRGVVLGGGAKGKKLAEAPLRRLGAAKLADRVVKAGEVLIKMAVISEKVHGQWYKALAL

SEQ ID NO: 262 - protein, 592 aa, Solanum lycopersicum
  misc_feature (261)..(261): Xaa can be any naturally occurring amino acid
  misc_feature (266)..(266): Xaa can be any naturally occurring amino acid
  misc_feature (276)..(276): Xaa can be any naturally occurring amino acid
  misc_feature (283)..(283): Xaa can be any naturally occurring amino acid
SCPKMLSEPGAEGLDSRGAFLVLIPSVIYVWIGKHCTSVMSDNARAAAFQVIRYEKAQGPVLIINEGKEPSDFWSAISQESFFSGGCGKEKNKVEASLLAENDLITDNISQCIGQKNEYDLDFEIFCKALAGGVVPPFPLSGTESETCLPARQNGWSRLRRKFSSGIMKEFITASKLYSHTGITSPVLDKIDTIKELSPALPSSPSSPQCGSPDSFSSYATSSPSWTKDPCRDVENPGLDTEPVSPSPSFSSLDSLSCFLXSKPKXNATSPSLSPXTSDYSSXFTFSPSSSNWSDLAYLSAQPSPTRFEHEDPNFVKNDFFKVSSSLLCKGSPFPAAEEAFPTSRALRRANSCLQYRETSPSLAERRGSHPPPMMMLRSNDDSAQISVKLVRTSSFSLPNFEDDTMKCVECDSLNDGDFVDTSKEALMLDAENSITDNQLQNGVQPVDDVSGSFNDRPIGIPIRVAETTDLGLYQWPSMHKLGLSSVVFDSRSVYIIVIPDLSLDENSSSSLYIWIGRDVQWKESLDQVINNDSMCEDNHVHWEKVGRGFIIQKGLANSSLVQIVKEGEEPEQLLKHLPRFSFDKALDVGIK

SEQ ID NO: 263 - protein, 313 aa, Sorghum bicolor
ARGNNNSTSSASSTGSTNSSALYKVDHEADCLDYEILWEDLVIGEQIGQGSCGTVYHALWYGSDVAVKVFSKQEYSEEVILTFRQEVSLMKKLRHPNILLFMGAVTSPQRLCIVTEYLPRGSLFRLLQKSATKLDVRRRVHMALDIARGMNYLHHSSPPIIHRDLKSSNLLGDRNWTVKVAHFGLSRLKRETFLTTKTGKGTPQWMAPEVLRNEPSDEKSDVYSYGVILWELVTQKIPWENLNSMQVIGAVGFMNQRLDIPDEVDPQWKSIILSCWESDPQQRPSFQELLERLRELQRHYAIQHRNTKNSIEE

SEQ ID NO: 264 - protein, 756 aa, Sorghum bicolor
MDSSGEELLKKIRELEVGQAQLKQEMSKLIPGAGERRRSQSVSPRRGAPVPPPPPAKGKAGAPGRRLSGGFEGGQRAWARGSASFPHSSPLQREGRAAGAGDASTSARLPERQYSRVLQSLGQSVHILDLDGRIIYWNQSAENLFGYPASEALGQDALMLLVDSHDHNAVNDIFRRISMGESWTGKFPVKNRQGDRFSALATNTPFYDEDGSLVGIICVSSDSRLLEQIFCKPPTSARPQSESSRTSCDGSCSNTSRRINLLNKSPFDPQLPLQSTLASKITNLATKVTNKVRSRVRTDENGIEREGGSGESHCSDRGAKEEPTSSGTNTPRGDAPHGPFATEENSPGKSMNPNSDESEGKIALHKIWSTKAEALLNKKGISWPWKGRENEGPDERNHVILPWLHGDQENGTNHQKVSDSSIVPDAQGAEHNQPNKNEASGSWSSFNNNSTSSASSTGSTNSSALYKVDHEADCLDYEILWEDLVIGEQIGQGSCGTVYHALWYGSDVAVKVFSKQEYSEEVILTFRQEVSLMKKLRHPNILLFMGAVTSPQRLCIVTEYLPRGSLFRLLQKSATKLDVRRRVHMALDIARGMNYLHHSSPPIIHRDLKSSNLLVDRNWTVKVADFGLSRLKRETFLTTKTGKGTPQWMAPEVLRNEPSDEKSDVYSYGVILWELVTQKIPWENLNSMQVIGAVGFMNQRLDIPDEVDPQWKSIILSCWESDPQQRPSFQELLERLRELQRHYAIQHRNTKNSIEE

SEQ ID NO: 265 - protein, 563 aa, Arabidopsis thaliana
MKIRNSPSFHGGSGYSVFRARNLTFKKVVKKVMRDQSNNQFMIQMENMIRRIVREEIQRSLQPFLSSSCVSMERSRSETPSSRSRLKLCFINSPPSSIFTGSKIEAEDGSPLVIELVDATTNTLVSTGPFSSSRVELVPLNADFTEESWTVEGFNRNILTQREGKRPLLTGDLTVMLKNGVGVITGDIAFSDNSSWTRSRKFRLGAKLTGDGAVEARSEAFGCRDQRGESYKKHHPPCPSDEVWRLEKIAKDGVSATRLAERKILTVKDFRRLYTVNRNELHNIIGAGVSKKTWNTIVSHAMDCVLDETECYIYNANTPGVTLLFNSVYELIRVSFNGNDIQNLDQPILDQLKAEAYQNLNRITAVNDRTFVGHPQRSLQCPQDPGFVVTCSGSQHIDFQGSLDPSSSSMALCHKASSSTVHPDVLMSFDNSSTARFHIDKKFLPTFGNSFKVSELDQVHGKSQTVVTKGCIENNEEDENAFSYHHHDDMTSSWSPGTHQAVETMFLTVSETEEAGMFDVHFANVNLGSPRARWCKVKAAFKVRAAFKEVRRHTTARNPREGL

SEQ ID NO: 266 - protein, 563 aa, Arabidopsis thaliana; identical to SEQ ID NO: 265

SEQ ID NO: 267 - protein, 240 aa, Arabidopsis thaliana
METEKKNSKEVALKHLAFVRIATIHILASVSNLYEYAKQNSGPLKSAVEKVEGAVTTVVTPVYQKFKDVPDSLLVFLDHKVGEVSYKFDEHAPPMAKKVVNQAHVLIYKATEKAQSFVKEARTGGPKAAFNYAATEYKFFVVTNSVKVWAKLNQYKPIHAMGDKALPVAAHFSSRYNDLVTDMTNMGYSLVGYLPLVPVDDIVKAYEKEDARRKKGGDTAGKKGETTDAADGDKSSSDSE

SEQ ID NO: 268 - protein, 240 aa, Arabidopsis thaliana; identical to SEQ ID NO: 267

SEQ ID NO: 269 - protein, 301 aa, Triticum aestivum
KYIYLADMMRFMRQEEAIKAMHLFEGAQEHCRVSKRSLKNWVVNAFRERKALALTLNDTKTAVNKLNQMCNVVVGLIVSALWLLILGIATTHFFVFISSQLLVAVFVFGNTMKTIFEAIIFLFVMHPFDVGDRCEIEEVQVVVEEMNIMTTVFLRYDNLKIYYPNSVLATKPIFNFYRSPDMGEGIDFSIHVATPVEKLALMKERILRYIDGKKEHWYPGTMVVLRDVDDTNKLKVSIWLRHTLNFQDMGMRFVRRELVLQEMIRVLKDLDIEYRMLPLDVNVRNVPPLQSTRMPTTWNYA

SEQ ID NO: 270 - protein, 426 aa, Triticum aestivum
  misc_feature (95)..(95): Xaa can be any naturally occurring amino acid
  misc_feature (97)..(97): Xaa can be any naturally occurring amino acid
  misc_feature (100)..(100): Xaa can be any naturally occurring amino acid
  misc_feature (104)..(105): Xaa can be any naturally occurring amino acid
  misc_feature (346)..(346): Xaa can be any naturally occurring amino acid
RAGADIPKELHPALPTKNLSGQRGTRVSGLISRGINPLSKEKKRREADEGITIDKLHRLNQRNVSAWNMKRLVKIVRFETLATMDEQIQQATTGXGXESXTQIXXEYEAQLAAKKIFHNVAKPGSKYIYLADMMRFMRQEEAIKAMHLFEGAQEHCRVSKRSLKNWVVNAFRERKALALTLNDTKTAVNKLNQMCNVVVGLIVSALWLLILGIATTHFFVFISSQLLVAVFVFGNTMKTIFEAIIFLFVMHPFDVGDRCEIEEVQVVVEEMNIMTTVFLRYDNLKIYYPNSVLATKPIFNFYRSPDMGEGIDFSIHVATPVEKLALMKERILRYIDGKKEHWYPGXMVVLRDVDDTNKLKVSIWLRHTLNFQDMGMRFVRRELVLQEMIRVLKDLDIEYRMLPLDVNVRNVPPLQSTRMPTTWNYA

SEQ ID NO: 271 - protein, 557 aa, Arabidopsis thaliana
MVLGCFPLKSKKKRGSVSMKRLDLEESKPTALPEPPKIPSRNLQSAPPSFRTRVKPIQSNNGGTGEMSSRARVMSAPSSIHGAAERDLLAGVYHDEQDEQPRDPRTSTKESSPQPLPLPSPRTGSSLKNWGSFKSFNGSSGRLSSSAAVSGPLPLPPSGSVRSFSYDEVMAACNAFSSDRCVMEGLSSVMYMASFGDEASTSGLKKVDATVVRLHVITQSIREFINEVNTLASLQHQNLCKLVGYHARDGSDTRMLVYERLALGSLDRLLHGRSDGPPLDWNTRMKIALCAAQGLTFLHEEGPFQAMYNEFSTANIQVDKDFSAKLSGYGCAGHAPETETSNSSALANLSVETLERGLLTPKSNVWSYGIVLLEMLTGRKNMDGSYPKEERNLVKWSRAFLADDCRLSLIMDPQLKGRFPAKAARSIADIAQKCLQVEPSERPTMRNIVDQLKIIQDMKYSCRFPLREPAPVVARKHMGRSSSLNTIIWTPASVPPRSSFSPSPPPRRPSVSPTRGRTLVFPPVFPPRACSSLEEMAREEVRRSSSASGRRTSLEGF

SEQ ID NO: 272 - protein, 436 aa, Sorghum bicolor
  misc_feature (6)..(6): Xaa can be any naturally occurring amino acid
  misc_feature (46)..(46): Xaa can be any naturally occurring amino acid
  misc_feature (252)..(252): Xaa can be any naturally occurring amino acid
MVQYSXDKMKTSLLLLPLFIALLSATSPLPSADALNVKGRLVKSKXFLSPPIFLRPGDVADKIYYDIAFPRGHLAFKSFNGEVVDEHGVPVPLHETYLHHWVVEPYYAAKDASTAAAEGRPRMIPARNSGVCNHTLGQYYGLGSETRRTATWVPDPYGIEIGDPDAAPEGYEERWMLNVHAIDTRRVVDKLACTECRCDLYNVTVDQYGRGIEDGYAGGLRCCYDETRCALEERGRLLVNADEEAPPRKVFXRYTVMWQDWSDAAVLPVKIYIFDVTACKVEYDVDECAAGNDNGGGGECVHVQTATQVLPRGGDVVFGVAHQHSGGIAASLHGEDGRLLCESTATYGDGEEAGNEAGYIVGMSTCYPKPGDVKVRDGEALTVVSRYSSERRHTGVMGLFYILVAEQQVPADGKPPGLCFSFPVSWCLPSWLSSNM

SEQ ID NO: 273 - protein, 428 aa, Sorghum bicolor
MKTSLFLLPLFVALLSATSPLPSADALNVKGRLVKSKTFLSPPIFLRPGDVADKIYYDIAFPRGHLAFKSFNGEVVDEHGVPVPLHETYLHHWVVEPYYAAKDASTAAAEGRPRMIPARNSGVCNHTLGQYYGLGSETRRTATWVPDPYGIEIGDPDAAPEGYEERWMLNVHAIDTRRVVDKLACTECRCDLYNVTVDQYGRGIEDGYAGGLRCCYDETRCALEERAGLLVNADEEAPPRKVFLRYTVMWQDWSDAAVLPVKIYIFDVTACKVEYDVDECAAGNDNGGGGECVHVQTATQVLPRGGDVVFGVAHQHSGGIAASLHGEDGRLLCESTATYGDGEEAGNEAGYIVGMSTCYPKPGDVKVRDGEALTVVSRYSSERRHTGVMGLFYILVAEQQVPADGKPPGLCFSFPVSWCLPSWLSSNM

SEQ ID NO: 274 - protein, 604 aa, Oryza sativa
PTTPRIPLPLLFYSSTPLHSPPGMADATHAAADGGVATILASADGRDFLLRNSADKVKISSIKASTVALYFSASWCPPCRRFTPKLIEAYNELVSQGKSFEVVFVSGDSDQDAFNAYFAKMPWLAVPFSDSEALAKLNERYKVMGIPHLVILDAKSGEIYTEDGVELVHEYGTEAYPFTTERINELKEQEKAAKDNQTIHSLFGTPTRDYLITNKGDKVPISDLEGKYVGLCFVVNGYGPVVQFTSVLAKIYEKLKAVGEKFEVVMVSLDGDEESFNESFADMPWLAIPQGDKMCEKLARYFELSGLPMLVLIGPDGKTLNDDIADIIDEHGPDAWEGFPFSAEKLEILAEKAKAKAESQTLESLLVTGDLDFVLGKDGAKVPVSELVGKTVLLYFSAKWCPPCRAFLPKLVNEYNKIKEKHNDFEIVFISSDREQSSYDEFFSGMPWLALPLGDERKQQLSKIFKITGIPSLVAIGPDGKTVTKDAKTPLVAHGADAFPFTEEKLQELEKEKEKKINDMAKGWPEKLKHDLHDHELVLTRCTTYGCDGCDEMGDSWSYRCKECDFDLHPKCALEEKGDVEMGEENAEAAPAGYVCEGDVCRKV

SEQ ID NO: 275 - protein, 581 aa, Oryza sativa
MADATHAAADGGVATILASADGRDFLLRNSADKVKISSIKASTVALYFSASWCPPCRRFTPKLIEAYNELVSQGKSFEVVFVSGDSDQDAFNAYFAKMPWLAVPFSDSEALAKLNERYKVMGIPHLVILDAKSGEIYTEDGVELVHEYGTEAYPFTTERINELKEQEKAAKDNQTIHSLFGTPTRDYLITNKGDKVPISDLEGKYVGLCFVVNGYGPVVQFTSVLAKIYEKLKAVGEKFEVVMVSLDGDEESFNESFADMPWLAIPQGDKMCEKLARYFELSGLPMLVLIGPDGKTLNDDIADIIDEHGPDAWEGFPFSAEKLEILAEKAKAKAESQTLESLLVTGDLDFVLGKDGAKVPVSELVGKTVLLYFSAKWCPPCRAFLPKLVNEYNKIKEKHNDFEIVFISSDREQSSYDEFFSGMPWLALPLGDERKQQLSKIFKITGIPSLVAIGPDGKTVTKDAKTPLVAHGADAFPFTEEKLQELEKEKEKKINDMAKGWPEKLKHDLHDHELVLTRCTTYGCDGCDEMGDSWSYRCKECDFDLHPKCALEEKGDVEMGEENAEAAPAGYVCEGDVCRKV

SEQ ID NO: 276 - protein, 230 aa, Zea mays
MTTAARPTWAPAKGGNEQGGTRIFGPSQKFSSRDLAAHTSLKPRKDGQQTQEELQKRNLREELEERERKHYSSKDKSYAEERDRRKSSSHLLLEGSKRETEDKIVPREIDADDSDVEPKSDDESDEDDDDDDTEALMAELERIKKERAEEKLRKERQQAEEEAKMKEAELMRGNPLININNAGSFSVKRRWDDDVVFKNQARGETKTPKRFINDTIRSDFHRKFLQRYMK

SEQ ID NO: 277 - protein, 578 aa, Arabidopsis thaliana
MEDDFDTQNQFPEEEPEEMDMDLPDNDEADSAPYLKIGEEMEIGKSGLKKKLVKECEKWDTPENGDEVEVHYTGTLLDGTKFDSSRDRGTPFKFTLGQGHVIKGWDLGIKTMKKGENAIFTIPPELAYGETGSPPTIPPNATLQFDVELIAWRSVKDICGDGGVSKKIIVEGEKWEKPKDLDEVYVKYEARLEDGTIVGKSDGVEFTVKEGHFCPALSKAVKTMKRGEKVLLTVKPQYGFGEFGRPASDGLQAAIPPNATLQIDLELVSWKTVVEVTDDRKVIKKILKEGEGYERPNEGAIVKLKLIGKLQDGTTVFVKKGHEEDEEPFEFKIDEEQVIEGLEKAVMGMKKGEVALITISPEYAFGSSESKQELAVIPPNSTVYYEVELVSFIKEKESWDMNTQERIEAAGKKKEEGNVLFKAGKYARASKRYERGVKYIEYDSTFDEEEKKKSKDLKIACNLNDAACKLKLKDYKEAAKLSTKVLEMDSRNVKAMYRRAHAYLETADLDLAELDIKKALEIDPDNKEVKIEYKKLKEKVKEYNKKDAKFYSNMLSKMLEPHKGTQKEAQAMSIDTKA

SEQ ID NO: 278 - protein, 578 aa, Arabidopsis thaliana; identical to SEQ ID NO: 277

SEQ ID NO: 279 - protein, 503 aa, Arabidopsis thaliana
SSLIKSKYHLRDSDSLCFSSTFQPKSTLKILRMIARILAALADSMEMPVAAGGGSVLGTIKIAVMPIAKVFTMCFLGLLMASKYVNILPPSGRKLLNGLVFSLLLPCLIFSQLGQAVTLQKMLQWWFIPVNVVLGTISGSIIGFIVASIVRPPYPYFKFTIIQIGVGNIGNVPLVLLAALCRDTSNPFGDSEKCSIDGTAYISFGQWVGAIILYTYVYQMFAPPPEGFDAEEENLALKTLPVDAAPEQVPLLTQNFPKDFSPTQDLLPVQSTEPRGRGVSRKGKIAQIFVFLYEKLKLKQIVQPAIVASILAMILGAIPFTKKLIFTNGAPLFFFTDSCMILGDAMIPCILLALGGNLINGPGSSKLGFKTTAAIIIGRLVLVPPVGLGIVTVADKLGFLPADDKMFRFVLLLQHTMPTSVLSGAVANLRGCGRESAAVLFWVHIFAIFSMAGWMVLYINILLLNSLLIDTFICYYTILLCKYSGISYVPEPTKILIFFFSFP

SEQ ID NO: 280 - protein, 431 aa, Arabidopsis thaliana
MIARILAALADSMEMPVAAGGGSVLGTIKIAVMPIAKVFTMCFLGLLMASKYVNILPPSGRKLLNGLVFSLLLPCLIFSQLGQAVTLQKMLQWWFIPVNVVLGTISGSIIGFIVASIVRPPYPYFKFTIIQIGVGNIGNVPLVLLAALCRDTSNPFGDSEKCSIDGTAYISFGQWVGAIILYTYVYQMFAPPPEGFDAEEENLALKTLPVDAAPEQVPLLTQNFPKDFSPTQDLLPVQSTEPRGRGVSRKGKIAQIFVFLYEKLKLKQIVQPAIVASILAMILGAIPFTKKLIFTNGAPLFFFTDSCMILGDAMIPCILLALGGNLINGPGSSKLGFKTTAAIIIGRLVLVPPVGLGIVTVADKLGFLPADDKMFRFVLLLQHTMPTSVLSGAVANLRGCGRESAAVLFWVHIFAIFSMAGWMVLYINILF

SEQ ID NO: 281 - protein, 56 aa, Arabidopsis thaliana
MKKKKMRKKNIHGLLLVKETETQREQRGVLVFDRGREKKEVWDDDSEELKVGYEEN

SEQ ID NO: 282 - protein, 896 aa, Arabidopsis thaliana
MSTVNHHCLLNFPHIPPSIPPNHRPKLLSSLSLYRKPERLFALSASLSLSPATIHECSSSSSSSSSSFDKEETEDIESVIDGFFYLLRLSAQYHDVEVTKAVHASFLKLREEKTRLGNALISTYLKLGFPREAILVFVSLSSPTVVSYTALISGFSRLNLEIEALKVFFRMRKAGLVQPNEYTFVAILTACVRVSRFSLGIQIHGLIVKSGFLNSVFVSNSLMSLYDKDSGSSCDDVLKLFDEIPQRDVASWNTVVSSLVKEGKSHKAFDLFYEMNRVEGFGVDSFTLSTLLSSCTDSSVLLRGRELHGRAIRIGLMQELSVNNALIGFYSKFWDMKKVESLYEMMMAQDAVTFTEMITAYMSFGMVDSAVEIFANVTEKNTITYNALMAGFCRNGHGLKALKLFTDMLQRGVELTDFSLTSAVDACGLVSEKKVSEQIHGFCIKFGTAFNPCIQTALLDMCTRCERMADAEEMFDQWPSNLDSSKATTSIIGGYARNGLPDKAVSLFHRTLCEQKLFLDEVSLTLILAVCGTLGFREMGYQIHCYALKAGYFSDISLGNSLISMYAKCCDSDDAIKIFNTMREHDVISWNSLISCYILQRNGDEALALWSRMNEKEIKPDIITLTLVISAFRYTESNKLSSCRDLFLSMKTIYDIEPTTEHYTAFVRVLGHWGLLEEAEDTINSMPVQPEVSVLRALLDSCRIHSNTSVAKRVAKLILSTKPETPSEYILKSNIYSASGFWHRSEMIREEMRERGYRKHPAKSWIIHENKIHSFHARDTSHPQEKDIYRGLEILIMECLKVGYEPNTEYVLQEVDEFMKKSFLFHHSAKLAVTYGILSSNTRGKPVRVMKNVMLCGDCHEFFKYISVVVKREIVLRDSSGFHHFVNGKCSCRDLW

SEQ ID NO: 283 - protein, 495 aa, Solanum lycopersicum
MARKMLIDGELSKPGEEEAHYDFDLFVIGAGSGGVRASRFSAQYGAKVAICELPFDPIGSEVSGGVGGTCVLRGCVPKKILVYGAAYGPELEDAKNYGWEVNENVNFNWKKLLHKKTEEIVRLNGIYKRLLSNAGVKLFEGEGRVVGPNEVELIQLDGTKISYSAKHILIATGSRAHRPDIPGQELAITSDEALSLEELPKRAVILGGGYIAVEFASIWRGMGSTVDLCFRKELPLRGFDDEMRAVVARNLEGRGITMHPCTTLTKLEKAEGGIKVHTDHGEVILADVVLVATGRLPNTKRLNLDAVGVELDNMKAVKVDEYSRTNIPSIWAIGDVTNRMNLTPVALMEGTCFAKTVFGGKPTKPDYSHIPCAVFCIPPLSVVGFSEEQAIEQINGEVSVYTSSFNPMKNTISGRTEKSVMKLLVDAQTDKVIGASMCGPDAPEIMQGIAVALKCGATKEQFDSTVGIHPSAAEEFVTMRSESRRISSNKPKTNL

SEQ ID NO: 284 - protein, 151 aa, Arabidopsis thaliana
MASLLDKAKDFVADKLTAIPKPEGSVTDVDLKDVNRDSVEYLAKVSVTNPYSHSIPICEISFTFHSAGREIGKGKIPDPGSLKAKDMTALDIPVVVPYSILFNLARDVGVDWDIDYELQIGLTIDLPVVGEFTIPISSKGEIKLPTFKDFF

SEQ ID NO: 285 - protein, 151 aa, Arabidopsis thaliana; identical to SEQ ID NO: 284

SEQ ID NO: 286 - protein, 496 aa, Oryza sativa
MARKMLKDEEVEVAVTDGGSYDYDLFVIGAGSGGVRGSRTSASFGAKVAICELPFHPISSDWQGGHGGTCVIRGCVPKKILVYGSSFRGEFEDAKNFGWEINGDINFNWKRLLENKTQEIVRLNGVYQRILGNSGVTMIEGAGSLVDAHTVEVTKPDGSKQRYTAKHILIATGSRAQRVNIPGKELAITSDEALSLEELPKRAVILGGGYIAVEFASIWKGMGAHVDLFYRKELPLRGFDDEMRTVVASNLEGRGIRLHPGTNLSELSKTADGIKVVTDKGEEIIADVVLFATGRTPNSQRLNLEAAGVEVDNIGAIKVDDYSRTSVPNIWAVGDVTNRINLTPVALMEATCFSKTVFGGQPTKPDYRDVPCAVFSIPPLSVVGLSEQQALEEAKSDVLVYTSSFNPMKNSISKRQEKTVMKLVVDSETDKVLGASMCGPDAPEIIQGMAVALKCGATKATFDSTVGIHPSAAEEFVTMRTLTRRVSPSSKPKTNL

SEQ ID NO: 287 - protein, 496 aa, Oryza sativa; identical to SEQ ID NO: 286

SEQ ID NO: 288 - protein, 228 aa, Saccharum officinarum
MAPAKSGEKATSFAMACSLLSRYVRQNGTASGDLGLAIRAEADAKRTSADTEKGETMKETMDLFPQNAGFGSEAAMKEAPDAREPEKRQLTIFYGGKVLVFDDFPAEKAKDLMQMASKGSSVAQNPGLLPSPTVATATDSTKIAAVPAAPIAVVNTQKSAADIPQAPKASLRRFLEKRKDRLTAKAPYQGSPSDATPVKKEMAEGQPWLGLGPQIANPDLSLCKEGSQ

SEQ ID NO: 289 - protein, 228 aa, Saccharum officinarum; identical to SEQ ID NO: 288

SEQ ID NO: 290 - protein, 138 aa, Zea mays
MYAGTSISAGMKGASKAMSAMNKQMEPAKQIKVMKEFQKQSTQLDMTLEMMSDAIDETLDKDEAEEETEELTNQVLDEIGVDVASQLSSAPKGRIGATNKKVDNGQARPARNVAAPALEPSSAEVEDLERRLASLRRT

SEQ ID NO: 291 - protein, 114 aa, Hordeum vulgare
MAMRPLVVLALAVALAGVALGEGAGECGRSSPDRMALRMAPCISAADEPDSAPSSSCCSAVHTIGKSPSCLCAVMLSGTAKMAGIKPEVAITIPKRCNMADRPVGYKCGDYTLP

SEQ ID NO: 292 - protein, 114 aa, Hordeum vulgare; identical to SEQ ID NO: 291

SEQ ID NO: 293 - protein, 196 aa, Saccharum officinarum
LMLLQKKGQFTWDEVVVMVLHMVRCREFTKYDPKINLVVCTRCCLFNIAFFDLNKESEVVPRPPISKIPVSDLWRLEDSVNVISIKVAESDVGYPINVYGTVLARDEYDYRCIYLFKRGRDNPQLITSPEDTLTLTGPYRAFGVTGNMFFEVHLKIKRDGAIDKDFNKALIQHNTSHHTCEPMAVSLVNCLSTVVM

SEQ ID NO: 294 - protein, 196 aa, Saccharum officinarum; identical to SEQ ID NO: 293

SEQ ID NO: 295 - protein, 741 aa, Oryza sativa
MARSRRRRIVQSNEEYLSEEQIEEENTLPQLATPSEQETVCHDSGEGNEDIDDDFDINDGEGNEDTNDDVDIDDEGNEDTDVDINVRVENGAPETRGKTKLKDVWNLPKGLRIVVQCNDLNQAVGEEAGILGKFLGMIARNGSLCSLGYTDWRYVIGKREKNTNELKVKKDILKQVKMRFLYAPRMEEFILKKIGERWRQYKAKLKDLYFDVNETKEANCNNVPEGVLSDQWIALVNHWMNEKSKRISEQNKKNCQKKKAIHTAGTKSFARTREEMRQKDPAKKNPHRAVVYVHTHKRKSDKNINGHVDNLKRLIAEQPALADASKGKTAWKGDALNQILGDDKPGRVHGLGLVPKPKQVLDVPTSRRLQNINLTTVEDNSSEDVMAIRLQMEKLERHVENNDAKLLQLKEKATKLEKAQKNQRVYGDNPSQEICMFEEGNIMDQQDNSLMNTQSHVHDENLQPPTKHSTVYKNTQSLGQNHSGKQRKITSCANKRKGNLDQNELMQPGKSISSAYKNNKPDNQDNYMLNAHKVTSTHKNKENLTRKLVRPSLNKYSTASKKRQCNTMDFLTDNSTVKVYGDGPLQEICHVEQENIVMNSQSHVQDEDKTPPTKHATAHKNKRTFGLNDHGKQMEIICAKKQQCSKMDFITDNSMEVGTKVFLKSWKNRNTNMALATIVSCDPTRRVGGVELGNEFLMVHVDLALAKSEDLIRLYKGYKIVGHVVGLEIAWSAIFVDKING

SEQ ID NO: 296 - protein, 741 aa, Oryza sativa; identical to SEQ ID NO: 295

SEQ ID NO: 297 - protein, 450 aa, Vitis vinifera
  misc_feature (108)..(108): Xaa can be any naturally occurring amino acid
  misc_feature (175)..(175): Xaa can be any naturally occurring amino acid
MAEFQNPDLEYVVDDYYDMTDFEEDSFSETDPQRNSPFEAFDSDVEDNFEMNKPKTDTSALEARNGKDIQGIPWERLNFTRDKYRETRLEQYKNYENLSRPREELEKXCKKIEKGSTFYDFQFNTRLVKSTIVHFQLRNLLWATSKHDVYLMQNYSVMHWSSLLRRGKEVLNVAXPIVSTLKCPGSLGQSLSRVQISTMTVKENLMVAGGFQGELICKNLSQPGVAFCAKLTTDDNAITNAVDVYHNPNGSLRVMAANNDAEVRIFDAENFACLNRFTYPWSVNNTSVSPDGKLLAVLGDSAECLLADAQTGKVVATLKGHLDYSFASAWHPDGRTLATGNQDTTCRLWDIRNLAESQAVLKGRMGAIRAVRFSSDGRFMAMAEPADFVHVFDTESGYVKGQEIDLFGEIAGISFSPDTEALFVGIADRTYGSLLEFNRRRCNQYLDSII

SEQ ID NO: 298 - protein, 450 aa, Vitis vinifera
MAEFQNPDLEYVVDDYYDMTDFEEDSFSETDPQRNSPFEAFDSDVEDNFEMNKPKTDTSALEARNGKDIQGIPWERLNFTRDKYRETRLEQYKNYENLSRPREELEKDCKKIEKGSTFYDFQFNTRLVKSTIVHFQLRNLLWATSKHDVYLMQNYSVMHWSSLLRRGKEVLNVAKPIVSTLKCPGSLGQSLSRVQISTMTVKENLMVAGGFQGELICKNLSQPGVAFCAKLTTDDNAITNAVDVYHNPNGSLRVMAANNDAEVRIFDAENFACLNRFTYPWSVNNTSVSPDGKLLAVLGDSAECLLADAQTGKVVATLKGHLDYSFASAWHPDGRTLATGNQDTTCRLWDIRNLAESQAVLKGRMGAIRAVRFSSDGRFMAMAEPADFVHVFDTESGYVKGQEIDLFGEIAGISFSPDTEALFVGIADRTYGSLLEFNRRRCNQYLDSII

SEQ ID NO: 299 - protein, 531 aa, Vitis vinifera
  misc_feature (387)..(387): Xaa can be any naturally occurring amino acid
  misc_feature (462)..(462): Xaa can be any naturally occurring amino acid
MNSEHNTNGVSDDLKAPLLPVQATTMETSNGASLMSIFTPKSFFILLGPLLCTLICLFVKLDGPVTSRNMLAVLAWMFAWWITEAVPMPITSMSPLFLFPLFGIASADDVAHSYMDDVISLVLGSFILALAVEHYNIHRRLALNITLIFCGDPLNPPLLLLGICATTAFVSMWMHNVAAALMMMPVATGILQRLPSGPTRSPHVDKFCRAVVLGVLYSAAVGGMSTLTGTGVNLILVGMWKSYFPEADPISFNTWFFFGFPLALLVFFALWAILCCLYCSRGAGPALSAYLDKSSLRRELQMLGPMAFAEKMVLAVFSMLIVLWMTRSITDDVPGWGALFNGRVGDGTASVMMATLLFIIPNKKQKGEKLMDWNKCKKLPWNIVLLXGAGFAIAAGVRSSGLADVLSKALTFLEHAPYLVIAPAVCLISSTVTEFTSNNSTTTLLVPLLIQVAQTMHVHPLXLMVPGAIGAQFSYLLPTGTPSNVVGFTTGHIEIKDMIKTGVPLKIAGIAALSLLMPSLGAYVFGTNEEM

SEQ ID NO: 300 - protein, 531 aa, Vitis vinifera
MNSEHNTNGVSDDLKAPLLPVQATTMETSNGASLMSIFTPKSFFILLGPLLCTLICLFVKLDGPVTSRNMLAVLAWMFAWWITEAVPMPITSMSPLFLFPLFGIASADDVAHSYMDDVISLVLGSFILALAVEHYNIHRRLALNITLIFCGDPLNPPLLLLGICATTAFVSMWMHNVAAALMMMPVATGILQRLPSGPTRSPHVDKFCRAVVLGVLYSAAVGGMSTLTGTGVNLILVGMWKSYFPEADPISFNTWFFFGFPLALLVFFALWAILCCLYCSRGAGPALSAYLDKSSLRRELQMLGPMAFAEKMVLAVFSMLIVLWMTRSITDDVPGWGALFNGRVGDGTASVMMATLLFIIPNKKQKGEKLMDWNKCKKLPWNIVLLLGAGFAIAAGVRSSGLADVLSKALTFLEHAPYLVIAPAVCLISSTVTEFTSNNSTTTLLVPLLIQVAQTMHVHPLLLMVPGAIGAQFSYLLPTGTPSNVVGFTTGHIEIKDMIKTGVPLKIAGIAALSLLMPSLGAYVFGTNEEM

SEQ ID NO: 301 - protein, 213 aa, Saccharum officinarum
  misc_feature (148)..(148): Xaa can be any naturally occurring amino acid
  misc_feature (197)..(197): Xaa can be any naturally occurring amino acid
  misc_feature (213)..(213): Xaa can be any naturally occurring amino acid
WVRVATCTTTTQPMAPRLLACFGRRGGGATASAPDDEGQQQEAAAPGPVLVELFASQGCGASPEADAVAARLAQDSGDDGAAVVVLAFHVDYWDYRGWKDPFASSAWTVRQKAYVEALRLDTLFTPQVVLQGRAHCVGTEQDALAQAXRDAPCYPAPAIKVTFQRPNPATLQASFTGTLRSRVEGPGGASVLVALYXSGLVTDCGRGRQGKSX

SEQ ID NO: 302 - protein, 200 aa, Saccharum officinarum
  misc_feature (200)..(200): Xaa can be any naturally occurring amino acid
MAPRLLACFGRRGGGATASAPDDEGQQQEAAAPGPVLVELFASQGCGASPEADAVAARLAQDSGDDGAAVVVLAFHVDYWDYRGWKDPFASSAWTVRQKAYVEALRLDTLFTPQVVLQGRAHCVGTEQDALAQAVRDAPCYPAPAIKVTFQRPNPATLQASFTGTLRSRVEGPGGASVLVALYKSGLVTDCGRGRQGKSX

SEQ ID NO: 303 - protein, 356 aa, Solanum lycopersicum
MGVQEMDPLTQLSLPPGFRFYPTDEELLVQYLCRKVAGHDFSLQIIAEIDLYKFDPWVLPSKAIFGEKEWYFFSPRDRKYPNGSRPNRVAGSGYWKATGTDKVITTDGRKVGIKKALVFYIGKAPKGTKTNWIMHEYRLSEPTTKTGSSRLDDWVLCRIYKKNSGGQKSSCSDLQNKDISHASSSSSSSQFDDMLESLPAIEDRYFSLPRVNSIRNFQQNDKINLQQLSSGNFDWAAMAGLNSFPEIRTGNQVPTPGNQTPVLINTNQYHNHNDNLNNFNEFFDNSKALNFHGEVNFEGGVDQEVESSVRAQRLNSVNPGFFQENSTGFSSSYTNLVPELFGIRYPTQTVNMGFTG

SEQ ID NO: 304 - protein, 356 aa, Solanum lycopersicum
  misc_feature (247)..(247): Xaa can be any naturally occurring amino acid
  misc_feature (284)..(284): Xaa can be any naturally occurring amino acid
  misc_feature (287)..(288): Xaa can be any naturally occurring amino acid
  misc_feature (292)..(292): Xaa can be any naturally occurring amino acid
  misc_feature (296)..(297): Xaa can be any naturally occurring amino acid
  misc_feature (309)..(309): Xaa can be any naturally occurring amino acid
  misc_feature (313)..(313): Xaa can be any naturally occurring amino acid
  misc_feature (322)..(322): Xaa can be any naturally occurring amino acid
  misc_feature (331)..(331): Xaa can be any naturally occurring amino acid
  misc_feature (336)..(336): Xaa can be any naturally occurring amino acid
  misc_feature (339)..(339): Xaa can be any naturally occurring amino acid
MGVQEMDPLTQLSLPPGFRFYPTDEELLVQYLCRKVAGHDFSLQIIAEIDLYKFDPWVLPSKAIFGEKEWYFFSPRDRKYPNGSRPNRVAGSGYWKATGTDKVITTDGRKVGIKKALVFYIGKAPKGTKTNWIMHEYRLSEPTTKTGSSRLDDWVLCRIYKKNSGGQKSSCSDLQNKDISHASSSSSSSQFDDMLESLPAIEDRYFSLPRVNSIRNFQQNDKINLQQLSSGNFDWAAMAGLNSFPEXRTGNQVPTPGNQTPVLINTNQYHNHNDNLNNFNEFFXNSXXLNFXGEVXXEGGVDQEVESSXRAQXLNSVNPGFXQENSTGFSXSYTNXVPXPFGIRYPTQTVNMGFTG

SEQ ID NO: 305 - protein, 226 aa, Brassica napus
  misc_feature (54)..(54): Xaa can be any naturally occurring amino acid
HTLSLHSNIHFQKKLYIIIISYFTPLKKRKMASNQQSYKAGETRGKTQEKTGQXMGAMRDKAEEGKNKTSQAAQTAQQKAHETAQSAKDKTSQTAQTTQSAKDKTSQAAQTTQDKARETKDKTGSYMSEAGEAIKNKAQDAAQYTKETAKGAAQYTKETAEADRDKTGGFLSQTGEHVKQIAMGAADAVKHTFGMATEEDDRENFPGTTTGTTRTTDTTHQTYQGK

SEQ ID NO: 306 - protein, 318 aa, Solanum lycopersicum
MATLRIPDVVPSPDEDSETLVKSFKGLGTNEKSVISVLGHRNASQRKKIRETYQQLYNKSLIDDINSELSGDFRKAVILWTYEPSERDARLANEALKSRKKTITQLQVIVEIACASSPDHLVAVRQAYCGLFNRSLEEDITANVPMPIQKILIGLVRSYRYDRELVDPSTANEEAAILREAIRTKQLDHDNFLFILSTRNGYQLRATFECYKQNYGFSIDQDIKSCGKGLLESILKVVIWCIESPEKHFAEVVRASILGFGTDEDSLTRAIVTRAEVDMMKVRGEYIIANKTSLDHAVIDDTSGDYRKFLMTLLGAKV

SEQ ID NO: 307 - protein, 318 aa, Solanum lycopersicum
MATLRIPDVVPSPDEDSETLVKSFKGLGTNEKSVISVLGHRNASQRKKIRETYQQLYNKSLIDDINSELSGDFRKAVILWTYEPSERDARLANEALKSRKKTITQLQVIVEIACASSPDHLVAVRQAYCGLFNRSLEEDITANVPMPIQKILIGLVRSYRYDRELVDPSTANEEAAILREAIRTKQLDHDNFLFILSTRNGYQLRATFECYKQNYGFSIDQDIKSCGKGLLESILKVVIWCIESPEKHFAEVVRASIVGFGTDEDSLTRAIVTRAEVDMMKVRGEYIIANKTSLDHAVIDDTSGDYRKFLMTLLGAKV

SEQ ID NO: 308 - protein, 223 aa, Hordeum vulgare
GDSSCGAVRCPPRSRFLRRPALRNRRRSRPPSRSSAPPANPLGFPPMETCPSVKNILLLDSEGKRVAVKYYTDDWPVLSAKLAFEKSVFVKTQKASSGAEAEIVMFDGHIVVYKFVQDLHFFVSGGDEENELILASVLQGFADAIDIILRNNVDKRTALENLDLILLCLDEIVDGGIVLETEGSVIAEKVLAHGAEGATSIAEQTIVQALTTAREHFAKSLLM

SEQ ID NO: 309 - protein, 76 aa, Hordeum vulgare
MAAAAPADAKAEAAKMDLLEDDDEFEEFEINQEWDDKEDGNEAVQQWEDDWDDDDVNDDFSLQLRKELEGGNTQKS

SEQ ID NO: 310 - protein, 76 aa, Hordeum vulgare; identical to SEQ ID NO: 309

SEQ ID NO: 311 - protein, 281 aa, Hordeum vulgare
RPARVSCLRRNALSSCSQSWSPPEPRHPSPPPRTPMGSSEADDDQLLKSFLAEVSEAERDNEVLRILGCFKLNPFEHLKLSFDSSVDEVKKQYRKLSLLVHPDKCKHPQAQEAFGALAKAQQLLLDPQERGYILDQVTSAKEELRAKRKKELRKDSASKIKSQVDEGKYEEQFERSDEFQKQLIIKVREILTDKEWRRRKMQMRISEEEGRLKKDEEETKEMWKRKREHEEKWEETRDQRVSSWRDFMKTGKKARKGELKPPRLKTEDPNKSYVQRPVKRG

SEQ ID NO: 312 - protein, 246 aa, Hordeum vulgare
MGSSEADDDQLLKSFLAEVSEAERDNEVLRILGCFKLNPFEHLKLSFDSSVDEVKKQYRKLSLLVHPDKCKHPQAQEAFGALAKAQQLLLDPQERGYILDQVTSAKEELRAKRKKELRKDSASKIKSQVDEGKYEEQFERSDEFQKQLIIKVREILTDKEWRRRKMQMRISEEEGRLKKDEEETKEMWKRKREHEEKWEETRDQRVSSWRDFMKTGKKARKGELKPPRLKTEDPNKSYVQRPVKRG

SEQ ID NO: 313 - protein, 217 aa, Lotus japonicus
RIQSSSNLSSFFVDLEKMWKGMNFREAEAADLINSDFRDLSLAATKLANHAVNLGVGFGFGASFFGLIAAIAAIYLLVLDRTNWKTNILTGLLIPYIFFSLPSIIFNVFRGEIGKWIALVAIVLRIFIPKHFPDWLELPAALIILIVVAPGLIANTFRDNIVGVVVCLVIACYLLQEHIRASGGFRNSFTKANGVSNSIGIIILLVYPIWAAVVIIF

SEQ ID NO: 314 - protein, 217 aa, Lotus japonicus; identical to SEQ ID NO: 313

SEQ ID NO: 315 - protein, 623 aa, Oryza sativa
MAKKNYGQVYNILGWGDPYFTVNSHGHLAVKPHGRDTMSGQDIDVHSVIHRALATTITTNDGDKKPQFPMILRFPDVLKNRLDSLHAAFHGAVDSTGYASRYQGVFPIKVNQNKAVVQDLVTFGHGYSYGLEAGSKPELLIAMSCLAKAKPGAYLVCNGYKDADYVALALSARAMGLNAIIVLEMEEELDIVVEQSARLGVEPVIGVRAKLLTKIPGHFGSTAGKHGKFGMLADKIYEVAGKLKKMGKLHWLKLLHYHVGSMIPTTDIVYNAAAEAAGIYCALVKEHGATGMTTLDCGGGLGVDYDGTRSGSSDMSVAYGLEQYASSIVQAVRLTCDDNGVPHPVLCTESGRAMASHHSMIILEALSAIPEPQDEEDTHHRLLSKIQDLSSKQPRTAHTVNGGGGVDAMHSHAVELKKHGIEMYKLAKKLSKRVTGDANGIYNYHMNLSVFSLVPDFWGIGQLFPMMPVSRLNEKPTINGTLVDITCDSDGKVEKFIRDAVTLPLHPLDDAAAEHGGYYVAALLSGAYQEALACKHNLFSGPTLVRVESAGGGGAFKIVSVELGPTAEEVIGTMRYDVKNDISDVIEKVATENGVWPMVEPLMKKGLTTMPYLNDYKPPKTTF

SEQ ID NO: 316 - protein, 623 aa, Oryza sativa; identical to SEQ ID NO: 315

SEQ ID NO: 317 - protein, 384 aa, Hordeum vulgare
  misc_feature (96)..(96): Xaa can be any naturally occurring amino acid
  misc_feature (123)..(123): Xaa can be any naturally occurring amino acid
MAAAAAICGEDEPAPRDPAAAAECAAAGGGVERLDLGDGRAALVAGGKRSVYLMECEPVWGCVATPGRGGEMEDACAAVPRFADVPVRLLARRQDXDGLGLDADALRLPSHLFAVFDGHGGSXVSNYCRERLHVVLSKELRRPPKDLGEMSDVDMKEHWDDLFTKCFQTVDDEVSGLASRLVDGEPRLEPIAAENVGSTAVAVVVCSSHVVVANCGDSRIVLSRGKEPVALSIDQKPDRKDERARIEAAGGKVIQWNGHRVSGILAMSRSIGDRYLKPYIIPKPEVTVVPRAKDDDCLILASDGLWDVVSNEEACKVARRQIQQWHKNNSVTTSSSDGGDGSTDPAAQAAADYLVRLALKKGSQDNITVIVVDLKPRRKSKNNS

SEQ ID NO: 318 - protein, 384 aa, Hordeum vulgare
MAAAAAICGEDEPAPRDPAAAAECAAAGGGVERLDLGDGRAALVAGGKRSVYLMECEPVWGCVATPGRGGEMEDACAAVPRFADVPVRLLARRQDLDGLGLDADALRLPSHLFAVFDGHGGSEVSNYCRERLHVVLSKELRRPPKDLGEMSDVDMKEHWDDLFTKCFQTVDDEVSGLASRLVDGEPRLEPIAAENVGSTAVAVVVCSSHVVVANCGDSRIVLSRGKEPVALSIDQKPDRKDERARIEAAGGKVIQWNGHRVSGILAMSRSIGDRYLKPYIIPKPEVTVVPRAKDDDCLILASDGLWDVVSNEEACKVARRQIQQWHKNNSVTTSSSDGGDGSTDPAAQAAADYLVRLALKKGSQDNITVIVVDLKPRRKSKNNS

SEQ ID NO: 319 - protein, 518 aa, Solanum tuberosum
SSVPEFMASPENDIYRPFLQNNVTSLSPQLSETHNFESSNELETVLLDTEIPLWSKLRLATWIEMKLLFFLAAPAVMVYMINYIMSMSTQIFSGHLGNLELAAASLGNTGIQVFAYGLMLGMGSAVETLCGQAFGAKKYDMLGVYLQRSTVLLTLTGILLTIVYIFCKPILIFLGQTERIAAAAALFVYGLIPQIFAYAINFPIQKFLQAQSIVAPSAYISAATLVLHLGLSWVVIFKIGLGLLGASLVLSLSWWIIVIGQFVYIVKSDKCKQTWKGFSWMAFTGLPEFFKLSAASAVMLCLETWYFQIVVLLAGLLENPEVALDALSICMSISGWVFMISVGFNAAASVRVSNELGARHPKSAAFSVVVVTSWSFILSMIAAVIVLALRNLISYAFTEGEVVAEAVSDLCPLLALSLILNGIQPVLSGVAVGCGWQAFVAYVNIGCYYIVGVPLGVLLGFYFKLGAKGIWSGMLGGTVMQTIILIWITARTDWNKEVESAQSRLKTWDDKKESILEE

SEQ ID NO: 320 - protein, 512 aa, Solanum tuberosum
MASPENDIYRPFLQNNVTSLSPQLSETHNFESSNELETVLLDTEIPLWSKLRLATWIEMKLLFFLAAPAVMVYMINYIMSMSTQIFSGHLGNLELAAASLGNTGIQVFAYGLMLGMGSAVETLCGQAFGAKKYDMLGVYLQRSTVLLTLTGILLTIVYIFCKPILIFLGQTERIAAAAALFVYGLIPQIFAYAINFPIQKFLQAQSIVAPSAYISAATLVLHLGLSWVVIFKIGLGLLGASLVLSLSWWIIVIGQFVYIVKSDKCKQTWKGFSWMAFTGLPEFFKLSAASAVMLCLETWYFQIVVLLAGLLENPEVALDALSICMSISGWVFMISVGFNAAASVRVSNELGARHPKSAAFSVVVVTSWSFILSMIAAVIVLALRNLISYAFTEGEVVAEAVSDLCPLLALSLILNGIQPVLSGVAVGCGWQAFVAYVNIGCYYIVGVPLGVLLGFYFKLGAKGIWSGMLGGTVMQTIILIWITARTDWNKEVESAQSRLKTWDDKKESILEE

SEQ ID NO: 321 - protein, 621 aa, Gossypium hirsutum
MRENSWFLICMWVLLVGNCLGRFVVEKNSLKVTSPESIKGVYECAIGNFGVPQYGGTLVGTVVYPKANQGACKSFDDFDISFKSKPGGLPTFLLVDRGDCFFTLKAWNAQKAGAAAILVADSKDEPLITMDTPEEENANAEYLQNITIPSALISKSLGDSLKKALNGGEMVNMNLDWRESLPHPDERVEYEFWTNSNDECGPKCDSQIEFVKNFKGAAQILEQKGYTMFTPHYITWYCPEAFILSKQCKSQCINHGRYCAPDPEQDFSKGYDGKDVVVQNLRQACLFKVANESGKPWLWWDYVTDFAIRCPMKEKKYNKECADKVIQALGVDLNKVDNCIGDTEADVDNPVLKAEQDAQIGKGSRGDVTILPTLVINNRQYRGKLDRGAVLKAICAGFQETTEPAICLTEDIQTNECLENNGGCWQDKSANITACRDTFRGRVCECPLVNGVKFSGDGYTHCEASAALRCEINNGGCWRETQEGRTYSACIDDHSHGCKCPYGFRGDGVKSCEDVDECKEKLACQCPGCKCKNTWGSYECSCSGGSLYMREHDTCISKNVKTEVSWGSVWVIILGLVAAGAGGYAIYKYRIRRYMDSEIRAIMAQYMPLDNQPNNVHHPDI

SEQ ID NO: 322 - protein, 621 aa, Gossypium hirsutum
  misc_feature (8)..(8): Xaa can be any naturally occurring amino acid
MRENSWFXICMWVLLVGNCLGRFVVEKNSLKVTSPESIKGVYECAIGNFGVPQYGGTLVGTVVYPKANQGACKSFDDFDISFKSKPGGLPTFLLVDRGDCFFTLKAWNAQKAGAAAILVADSKDEPLITMDTPEEENANAEYLQNITIPSALISKSLGDSLKKALNGGEMVNMNLDWRESLPHPDERVEYEFWTNSNDECGPKCDSQIEFVKNFKGAAQILEQKGYTMFTPHYITWYCPEAFILSKQCKSQCINHGRYCAPDPEQDFSKGYDGKDVVVQNLRQACLFKVANESGKPWLWWDYVTDFAIRCPMKEKKYNKECADKVIQALGVDLNKVDNCIGDTEADVDNPVLKAEQDAQIGKGSRGDVTILPTLVINNRQYRGKLDRGAVLKAICAGFQETTEPAICLTEDIQTNECLENNGGCWQDKSANITACRDTFRGRVCECPLVNGVKFSGDGYTHCEASAALRCEINNGGCWRETQEGRTYSACIDDHSHGCKCPYGFRGDGVKSCEDVDECKEKLACQCPGCKCKNTWGSYECSCSGGSLYMREHDTCISKNVKTEVSWGSVWVIILGLVAAGAGGYAIYKYRIRRYMDSEIRAIMAQYMPLDNQPNNVHHPDI

SEQ ID NO: 323 - protein, 93 aa, Hordeum vulgare
GDFSDTMKEPLKASRSKILVVLLVFAMVTQGLVICVKGIERNDIAGKAVSAKPTLGAGSSTTVDNHHAIPRDQYSSHGGEDGSGGSGGDTTKN

SEQ ID NO: 324 - protein, 93 aa, Hordeum vulgare; identical to SEQ ID NO: 323

SEQ ID NO: 325 - protein, 304 aa, Hordeum vulgare
GTRLDPSPHCQSRLPFFLAAPLSLLRLKPSKALSGQRESKKSRGMKIQCDSCGVAAATVVCCADEAALCARCDVEIHAANKLASKHQRLPLDALGAKLPRCDICQEKAAFIFCVEDRALFCRDCDEPIHVPGTLSGNHQRYLATGIRVGLGPVSTCAAGDHGASHDADHHAPPKVACDHQPPAQPAASAQQVPSPPQFLPQDWAVDELLQFSDYESSDKLHKDSTLGFKELEWFTADMELFHDHAPKGGRAAMEVPEFFASQAADDAAYYRQSRVAATAGVRQSKKARVEIADDEDFFIVPDLG

SEQ ID NO: 326 - protein, 90 aa, Gossypium hirsutum
MGKRKTQRKNATMLDSDDDNSSVSSSSTMRSDRMSVSASEEVEFNKDSLLDEAVDALYEKRGSTREKALAVIIEAFNSNLQQGQQFVERK

SEQ ID NO: 327 - protein, 448 aa, Gossypium hirsutum
  misc_feature (224)..(224): Xaa can be any naturally occurring amino acid
MGKRKTQRKNATMLDSDDDNSSVSSSSTMRSDRMSVSASEEVEFNKDSLLDEAVDALYEKRGSTREKALAVIIEAFNSNLQQGQQFVERKFATLLHQCLNSIKKGSSKEISLASHTIGLLALTVGPGDNAREILEESMIPLSQAFKSGSDPSKTASLLECMAVITFVGGNDPEDTEKSMQIIWQVVHPKLGSNVVAVKPSAAVITAVVSAWSFLLTTMDGWRLXPKLWQESITYLSSLLDKDDRSVRIAAGEALAVIFEMGSLEKFAAETKGSSDGSVSEGNKSKEGFSYIQGLKGKILNQVRDLSVEAGGKGSAKKDLNNQRNLFKDVLEFLEDCYSPNTSMKIGGDLLQTSSWSQLIQLNFLRCFLAGGFTKHMQENEFLQDIFGFTPNKRNLLGSEHMSNGEKRMYKSPNSALNKARTQLLNKQRMLSAGRNFGHYAVNVGDEDS

SEQ ID NO: 328 - protein, 448 aa, Gossypium hirsutum
  misc_feature (174)..(174): Xaa can be any naturally occurring amino acid
  misc_feature (182)..(182): Xaa can be any naturally occurring amino acid
  misc_feature (185)..(185): Xaa can be any naturally occurring amino acid
MGKRKTQRKNATMLDSDDDNSSVSSSSTMRSDRMSVSASEEVEFNKDSLLDEAVDALYEKRGSTREKALAVIIEAFNSNLQQGQQFVERKFATLLHQCLNSIKKGSSKEISLASHTIGLLALTVGPGDNAREILEESMIPLSQAFKSGSDPSKTASLLECMAVITFVGGNDPEXTEKSMQIXWQXVHPKLGSNVVAVKPSAAVITAVVSAWSFLLTTMDGWRLSPKLWQESITYLSSLLDKDDRSARIAAGEALAVIFEMGSLEKFAAETKGSSDGSVSEGNKSKEGFSYIQGLKGKILNQVRDLSVEAGGKGSAKKDLNNQRNLFKDVLEFLEDCYSPNTSMKIGGDLLQTSSWSQLIQLNFLRCFLAGGFTKHMQENEFLQDIFGFTPNKRNLLGSEHMSNGEKRMYKSPNSALNKARTQLLNKQRMLSAGRNFGHYAVNVGDEDS

SEQ ID NO: 329 - protein, 346 aa, Solanum lycopersicum
AREMGEEISNKQILLKDYVNGFPKESDMELRISSMKLKVPEDSNSVLVKNLYLSCDPYMRPRMKKTEGSYTDSFTPGSPIVGFGVAKVVDSAHPKFKKDELVWGITGWEEYSVIKAPETLFKIHNTDVPLSYYTGILGMPGITAYGGFYELCSPKKGETVYVSAASGAVGQLVGQFAKLIGCYVVGSAGSKEKVELLKNKFGFDEAFNYKEEQDLSAALKRYFPDGIDIYFENVGGKMLDAVLLNMRVHGRIAVCGMISQYNLEQNEGVHNLFCLISKRLRMQGFLAVDYFPLYKKFVEMVTPHIKEGKVTYVEDIAEGIESAPGALVGLFSGRNVGKQVVLVARE

SEQ ID NO: 330 - protein, 343 aa, Solanum lycopersicum
MGEEISNKQILLKDYVNGFPKESDMELRISSMKLKVPEDSNSVLVKNLYLSCDPYMRPRMKKTEGSYTDSFTPGSPIVGFGVAKVVDSAHPKFKKDELVWGITGWEEYSVIKAPETLFKIHNTDVPLSYYTGILGMPGITAYGGFYELCSPKKGETVYVSAASGAVGQLVGQFAKLIGCYVVGSAGSKEKVELLKNKFGFDEAFNYKEEQDLSAALKRYFPDGIDIYFENVGGKMLDAVLLNMRVHGRIAVCGMISQYNLEQNEGVHNLFCLISKRLRMQGFLAVDYFPLYKKFVEMVTPHIKEGKVTYVEDIAEGIESAPGALVGLFSGRNVGKQVVLVARE

SEQ ID NO: 331 - protein, 516 aa, Vitis vinifera
  misc_feature (211)..(211): Xaa can be any naturally occurring amino acid
  misc_feature (215)..(215): Xaa can be any naturally occurring amino acid
  misc_feature (219)..(220): Xaa can be any naturally occurring amino acid
  misc_feature (253)..(254): Xaa can be any naturally occurring amino acid
  misc_feature (398)..(398): Xaa can be any naturally occurring amino acid
MGVVTVSSSASRTPFGLNAKFSNHQTPLRRPLVLAFKADKAKNIALVTPHEPIPLPIETSKDHKKRLGRASKPSKRVKAVSTDEVSPCSVELDYNEAAAKLENIYKLSPATDVSEAEDLERVVRRGRQRRKRVTLPDDKAEKEISDNVVRIHNKKPKRLSLEKRIALSKMKQEKAVASIQKKRDSKNEDENIDMLVREYSASTDLVSLDWXKMKXPPVXXSSEHAWLFKLMQPMKGLLEVKDNLQKDLGREPXXGELAEAMSMSAVQVRRYMEVGQAARNKLIKHNLRLVLFVINKYFQEFANGPKFQDLCQAGVKGLITAIDRFEPKRSFRLSTYGLFWIRHAIMRSMTLSSFTRVSFGLESVRVEIQRAKLELLFKLQRLPTEEEIIEKVGISPEXYHEVMRASKSVLSLHARHATTQEEYISGITDVEGVGGDRGRQLALLRLALDDVLDSLKPKESLVMRQRYGLDGKGDRTLGEIAGNLSISREMVRKHEVKALMKLKHPARVDYLRQYIF

SEQ ID NO: 332 - protein, 516 aa, Vitis vinifera
MGVVTVSSSASRTPFGLNAKFSNHQTPLRRPLVLAFKADKAKNIALVTPHEPIPLPIETSKDHKKRLGRASKPSKRVKAVSTDEVSPCSVELDYNEAAAKLENIYKLSPATDVSEAEDLERVVRRGRQRRKRVTLPDDKAEKEISDNVVRIHNKKPKRLSLEKRIALSKMKQEKAVASIQKKRDSKNEDENIDVLVREYSASTDLVSLDWKKMKIPPVLPPSEHAWLFKLMQPMKGLLEVKDNLQKDLGREPTDGELAEAMSMSAVQVRRHMEVGQAARNKLIKHNLRLVLFVINKYFQEFANGPKFQDLCQAGVKGLITAIDRFEPKRSFRLSTYGLFWIRHAIMRSMTLSSFTRVSFGLESVRVEIQRAKLELLFKLQRLPTEEEIIEKVGISPERYHEVMRASKSVLSLHARHATTQEEYINGITDVEGVGGDRGRQLALLRLALDDVLDSLKPKESLVMRQRYGLDGKGDRTLGEIAGNLSISREMVRKHEVKALMKLKHPARVDYLRQYIF

SEQ ID NO: 333 - protein, 229 aa, Hordeum vulgare
RHSRRRRRESSRARATTTTATATSAAATMSPIRALIVLAAVLAACLRPAAAADQPGSGEGHTIAGRIKIEAARGFGLPAKTSNTKVILNGGQKVTFARPDGYFAFHNVPAGTHLIEVSSLGYFFSPVRVDISARNPGHIQAALTENRRVLNELVLEPLKEEQYYEMREPFNILSLLKSPMGMMVGFMVVMVFVMPKMMENIDPEEIKQAQEQMRNSPASFSGLLARANS

SEQ ID NO: 334 - protein, 883 aa, Solanum lycopersicum
MGDNRGLGVFGVSMCGAAQEIEQLSRESSHYSLSTGILPSLGARSNRRVKLKRFIISPYDRQYRLWETFLVVLVVYTAWVSPFEFGFLGKPAGPLAKTDNVVNGFFAIDIILTFFVAFLDRTTYLLVDEHKKIAWKYMSTWFLFDVISTIPSELAVKISPKPLRQYGLFNMLRLWRLRRVSALFARLEKDRNFNYFWVRCAKLVCVTLFAVHCAGCFYYLIAVHYPDPKRTWIGVAMDDFLNQSLWIRYVTSIYWSITTLTTVGYGDLHPENTREMIFDIFYMLFNLGLTAYLIGNMTNLVVHGTSRTRKFRDTIQAASSFAQRNQLPARLQDQMLAHLCLKFRTDSEGLQQQETLESLPKAIRSSVSHFLFYSLVDKVYLFRGVSNDLLFQLVSEMKAEYFPPKEDVILQNEAPTDFYILVTGAVDLVVLKNGVEQVVGEVRAGDLCGEIGVLCYRPQLFTVRTKRLCQLLRMNRTTFLNIVQANVGDGTIIMNNLLQHLKEMKNPIMEGVLLETEHMLARGRMDLPLTLCFATLRSDDLLLHHLLKRGLDPNESDNNGRSALHIAASKGIENCVVLLLDFGADPNSRDSEGNVPLWEAIMGKHESVIQLLVDNGAKLSAGDVGHFACVAVEQNNLSLLKEIVRYGGDVTLPKINGSSALHVAVCEGNIEIVKYLLDRGANVDQPDEHNWTPRDLAEQQGHEDIKELFESRVMMRTRSVDPIPEERGVRFLGRFKSEPTISPASHGVSFLGLDGSLGRSRPRRRSNNFHNSLFGIMSAKQTNASDVLLSANDTNVSSTTTKTYAPRVIVCCPEKGDNGGKLILLPQSFKELLQIGSSRYGISQAKVVSKDGAEIDEIELIRDGDRLVFVRDKENNIDEAKSS

SEQ ID NO: 335 - protein, 883 aa, Solanum lycopersicum; identical to SEQ ID NO: 334

SEQ ID NO: 336 - protein, 777 aa, Nicotiana tabacum
MLPMFEKIELLVIFDYPILLQKESWRTVLALAYQSLGVVYGDLSTSPLYVYKSTFAEDIQHSESDDEIFGVLSFVFWTLTLIPLLKYVFIVLRADDNGEGGTFALYSLLCRHARVSTLPNGQLADEDLYEYKNDRNLSADRIGMSLKSTLEKHRFLKKILLILALIGTCMVIGDGVLTPAISVFSAVSGLELSMAKHHHQYVEVPVACVILVFLFFLQHYGTHRIGFLFAPIVITWLLCISAIGLYNIFLWNPHVYQALSPYYMYKFLKKTQRGGWMSLGGILLCITGSEAMFADLGHFSQLSIQIAFTFVVYPSLILAYMGQAAYLSKHHVIQGDYHIGFYVSVPEKLRYPVLAIAILAAVVGSQAIITGTFSIIKQCSALGCFPRVKIVHTSSKIHGQIYIPEINWTLMLLCLAVTIGFRDTKHISNASGLAVITVMLVTTCFMSLVIVLCWHKNVLLAICFIFFFGSIEALYFSASLIKFLEGAWVPIVLSLIFLVVMYSWHYGTLKKYEFDVENKIPINWLLTLSPNLGITRVRGIGLIHTELVSGIPAIFSHFVTNLPAFHQVLVFLCVKSVPVPHVRPEERFLVGRIGPKEYRVYRCIARYGYRDIHMDDVEFEKDLVCSIAEFIRSEGPAQSFETVEGIDDNEKLTVIGTTSTHVDGVTMCEDVDTKDTEMIEISSPEVPRKRVRFLVPESPQMDLSVRAELQELMEAREAGMAFILGHCYVRAKRGSSLIKKLVVDIGYDFLRRNCRGPTYALSFPRASTLEVGMIYHV

SEQ ID NO: 337 - protein, 777 aa, Nicotiana tabacum; identical to SEQ ID NO: 336

SEQ ID NO: 338 - protein, 815 aa, Medicago sativa
MLGGEADRVSIEDETETTKEITEKKLKDRKVSWAKLRRVDSLNLEAGRVSMNANHNSKVGWSVTLTLAFQSIGIVYGDIGTSPLYVYASTFAKGIKNNDDILGVLSLIIYTIVLIPMLKYVFIVLWANDNGNGGAFALYSLICRHIKMSLAPNQQPEDMELSNYKLEIPSSQQKRAHKLKQMLENSHFARIILLLLAIMGTAMVIGDGILTPSISVLSAVSGISTSLGQNAVVGITVAILVVLFSLQRFGTDKVGVLFAPVILIWFIFIGGIGLYNLFKYDIGVLKAFNPKYIVDYFKRNGKEGWLSLGGVFLCITGSEAMFADLGHFSVRAIQISFSFVTFPAILTAYIGQAAYLRQFPDKVGNTFYESIPDPLYWPTFVVAIGAAIIASQAMISGAFSIISQALSLGCFPRVKVVHTSANHEGQVYIPEINYMFLIGCIVVCVAFKTTENISHAYGIAVIGDMLITTTLVSLIMLVIWKKSLWMVSLFFFVFGFIEILYFSSQITKFSKGGYFPIVLAMFLTMVMGIWHYVHKERYMFELKNKVSTEYLRELANRTDVHRVPGIGLLYSELVQGIPPIFPHFIASVPSIHSVVVFVSIKTIPVNRVALEERFLFRQVEPREYRIFRCVARRGYNDVLGNPAEFESQLIQNLKEFIQQQDFMLEVNEGAATTTTSEQLVVSTAINENDQMQDISGKEVKPRSNNSSGRIIPSHGVSSDSIRSLPASVRKSSNFYEPIIIQGPEEEIKFIDKATENGVVYMIGEAEVVAHPNSSILNKIVVNYAYSFLRKNFRQGEDSIAIPRKRLLKVGMTYEI

SEQ ID NO: 339 - protein, 815 aa, Medicago sativa; identical to SEQ ID NO: 338

SEQ ID NO: 340 - protein, 471 aa, Brassica napus
  misc_feature (260)..(260): Xaa can be any naturally occurring amino acid
ARGSVSPSPHHVVLFPYMSKGHTIPLLQFARLLIRHRRVISSSNDGEEPSMSITIFTTPQNKPFISNFLSDVTSSIKIISLPFPENIAGIPPGVESTDKLPSMSLYVPFTRATKSLQPLFEETLKNLPQVTFMVSDGFLWWTLDSAAKFEIPRLAFFGMNSYSSALYNSVSVHQLFTKPGNIKSDTEPVTVPDFPWIRVKKCDFVPVCIEPDQSGPEFDLLMDQLMSTGKSRGVIVNSFYELESTFVDHRLGVRGEPKPXCVGPLCLVNPPKPESDKPIWIDWLDRKREERCPVLYVAFGTQAEISNEQLREIALGLEDSKANFLWVTRMDVEDMIGVGFEKRVREHGMIVRDWVDQWEILSHESAKGFLSHCGWNSAQESICAGIPVLAWPMMAEQPLNAKLVVEELKVGVRIETEDGTLEGFVSREEVSQKVKVLMEGEMGKTARKNVKEYAEMAREAWAQGTGSSWKN

SEQ ID NO: 341 - protein, 493 aa, Brassica napus
MSVSPSPHHVVLFPYMSKGHTIPLLQFARLLIRHRRVISSSNDGEEPSMSITIFTTPQNKPFISNFLSDVTSSIKIISLPFPENIAGIPPGVESTDKLPSMSLYVPFTRATKSLQPLFEETLKNLPQVTFMVSDGFLWWTLDSAAKFEIPRLAFFGMNSYSSALYNSVSVHQLFTKPGNIKSDTEPVTVPDFPWIRVKKCDFVPVCIEPDQSGPEFDLLMDQLMSTGKSRGVIVNSFYELESTFVDHRLGVRGEPKPWCVGPLCLVNPPKPESDKPIWIDWLDRKREERCPVLYVAFGTQAEISNEQLREIALGLEDSKANFLWVTRMDVEDMIGVGFEKRVREHGMIVRDWVDQWEILSHESVKGFLSHCGWNSAQESICAGIPVLAWPMMAEQPLNAKLVVEELKVGVRIETEDGTLEGFVSREEVSQKVKVLMEGEMGKTARKNVKEYAEMAREALAQGTGSSWKNLSLLLEELCKIRETNDVNKLSSHD

SEQ ID NO: 342 - protein, 466 aa, Solanum tuberosum
MTDSTEESKLEIVMFPWLAFGHLIPYMNLSNELAKRGHKISFLLPKNAEIRLQKLNLYPNLIKFHKLTIPHVDGLPYGAETTADVHRSLESLLATAMDELYDEIKSFLQNLKPHFVFFDFAYWIPDLAREIGGIKTLFYTVFCPAVACILFIRSPDKAIFMASTAAELVKPPPGYPSTTMVLRECEAKLLSFIFHEYGKGVTFYERVKKGMTRCDAIAMKTCREIEGNFCDYISTQFEKPVLYTGPVISEPKKEPLEEHGISNWLEKFEPRSVVFCAFGSQLILEKKQFQELVLGFELTELPFLLVVKPPQGTNSVEEALPEGFKQRVQEKGLILDCWVPQLEILRHKSVGCFVTHCGYGSMWESLALCDCQLVLLPRPIDHIFNARLMEKQLKVGVEVEKDENDLFTKENLCKAVKCVMDKDSQIGCLVKENHMKWKELLSSPGFMSNYIDNFIQDLHALLVEKT

SEQ ID NO: 343 - protein, 466 aa, Solanum tuberosum; identical to SEQ ID NO: 342

SEQ ID NO: 344 - protein, 274 aa, Vitis vinifera
MSFQDLESGRPLAQSRRDYINAKQDPTQAVASGIFQINTAVSTFQRLVNTLGTPKDTSELREKLHKTRLHIGQLVKDTSAKLKQASETDHHAEVSASKKIADAKLAKDFQAVLKEFQKAQRLAAERETAYTPFVPQSVLPSSYTASEIDVGPDKSPEQRALLVESRRQEVLLLDNEIVFNEAIIEEREQGIQEIQHQIGEVNEIFKDLAVLVHEQGVMIDDIGSNIDGAQAATAQAKSQLAKASKTQRSNSSLTCLLLVIFGIILLIVIIVIAA

SEQ ID NO: 345 - protein, 274 aa, Vitis vinifera; identical to SEQ ID NO: 344

SEQ ID NO: 346 - protein, 584 aa, Saccharum officinarum
MSEQQPLPQPRSSMREALEKEDKEKAVAAAAKEKATVPKNGGNGGGGKNGGGGNGGGAPPSGEETAREIQVVREAYRRETAAPAYVIPEEPPAMVELVGWYIYGFCSYFITHLLLPVLFPVIVTQIAYPNSDFTPDPKYTLKGATCSVHEMSMYQRLTKHSIVIDGSRMSPLGWSGLSWAIGILIVAPLLTQTAHHLDRGQYQSLILIAATSFGSFFCLLTGFFKTVWVFLFYIIFIAGSIIVAEAVHTRNLGLMIRGLAAHDSGKHLVLRRRAAASQLSLYCTAIGGIGAALMAAFMYHMLRRTDQLTGLWVVSIFCGLIWFIGICHGLFTNRPSSSSPTTAFEPNFFTKLSYSMTLLRYPQAIGSLVAVFLSSFATMCIFTSGTLYAIGGVCIKPVLVLVLWILYFLFPLISLPLLHPIQIIIRADAVRMQLLGFIICLFVSGAGFYFKSHRWRAAHIIVIALVQSTANGILYAFGRILLLDASPPGKEGAFSVWYAFVRVTGAMIGFAASSAGPGRAGGSFAAAFLGSFLGIIVLIFGNVSNIGALKAAGHLKGMDDEKRMEKGEGMGGAVADSGESRGRV

SEQ ID NO: 347 - protein, 584 aa, Saccharum officinarum; identical to SEQ ID NO: 346

SEQ ID NO: 348 - protein, 421 aa, Saccharum officinarum
GRKARRRTGLGSGERGERRVLRPEAMGRLRDGRAFLHRALVLSSLLLLASGEIFFEERFDDGWDSRWVKSDWKKSQGQAGTFRHTAGTYSGDPDDKGIQTTGDAKHFAISAKFPEFSNKGRTLVIQYSLKIEQDIECGGAYIKLMSGYLNQKKFGGDTPYSFMFGPDICGDQKKKLHLILSYQGQNYPIKKDLKCEADKLTHFYTFILRPDATYSILIDNREREFGSMYTDWDILPPRKIKDVNAKKPKDWDDREYIEDPDQVKPEGYDSIPKQIPDPKDKKPESWDDDEDGTWKPRMIPNPEYKGPWKRKKIKNPNYKGKWKTPWIDNPEFEDDPDLYVLKPLQYVGIEVWQVKAGSVFDNILICDDPDYARHVVDETFAANKEAEKEAFEGAEKKRKAREEEEARRAREEGERTKRGKG

SEQ ID NO: 349 - protein, 437 aa, Saccharum officinarum
GRKARRRTGLGSGERGERRVLRPEAMGRLRDGRAFLHRALVLSSLLLLASGEIFFEERFDDGWDSRWVKSDWKKSQGQAGTFRHTAGTYSGDPDDKGIQTTGDAKHFAISAKFPEFSNKGRTLVIQYSLKIEQDIECGGAYIKLMSGYLNQKKFGGDTPYSFMFGPDICGDQKKKLHLILSYQGQNYPIKKDLKCEADKLTHFYTFILRPDATYSILIDNREREFGSMYTDWDILPPRKIKDVNAKKPKDWDDREYIEDPDQVKPEGYDSIPKQIPDPKDKKPESWDDDEDGTWKPRMIPNPEYKGPWKRKKIKNPNYKGKWKTPWIDNPEFEDDPDLYVLKPLQYVGIEVWQVKAGSVFDNILICDDPDYARHVVDETFAANKEAEKEAFEGAEKKRKAREEEEARRAREEGERRRRERDRDRGRDRYRDRYKDEL

SEQ ID NO: 350 - protein, 445 aa, Saccharum officinarum
GRKARRRTGLGSGERGERRVLRPEAMGRLRDGRAFLHRALVLSSLLLLASGEIFFEERFDDGWDSRWVKSDWKKSQGQAGTFRHTAGTYSGDPDDKGIQTTGDAKHFAISAKFPEFSNKGRTLVIQYSLKIEQDIECGGAYIKLMSGYLNQKKFGGDTPYSFMFGPDICGDQKKKLHLILSYQGQNYPIKKDLKCEADKLTHFYTFILRPDATYSILIDNREREFGSMYTDWDILPPRKIKDVNAKKPKDWDDREYIEDPDQVKPEGYDSIPKQIPDPKDKKPESWDDDEDGTWKPRMIPNPEYKGPWKRKKIKNPNYKGKWKTPWIDNPEFEDDPDLYVLKPLQYVGIEVWQVKAGSVFDNILICDDPDYARHVVDETFAANKEAEKEAFEGAEKKRKAREEEEARRAREEGERRRRERDRDRGRDRYRDRYKRHRHYDYHDEL

SEQ ID NO: 351 - protein, 420 aa, Saccharum officinarum
MGRLRDGRAFLHRALVLSSLLLLASGEIFFEERFDDGWDSRWVKSDWKKSQGQAGTFRHTAGTYSGDPDDKGIQTTGDAKHFAISAKFPEFSNKGRTLVIQYSLKIEQDIECGGAYIKLMSGYLNQKKFGGDTPYSFMFGPDICGDQKKKLHLILSYQGQNYPIKKDLKCEADKLTHFYTFILRPDATYSILIDNREREFGSMYTDWDILPPRKIKDVNAKKPKDWDDREYIEDPDQVKPEGYDSIPKQIPDPKDKKPESWDDDEDGTWKPRMIPNPEYKGPWKRKKIKNPNYKGKWKTPWIDNPEFEDDPDLYVLKPLQYVGIEVWQVKAGSVFDNILICDDPDYARHVVDETFAANKEAEKEAFEGAEKKRKAREEEEARRAREEGERRRRERDRDRGRDRYRDRYKRHRHYDYHDEL

SEQ ID NO: 352 - protein, 1035 aa, Sorghum bicolor
  misc_feature (262)..(262): Xaa can be any naturally occurring amino acid
  misc_feature (706)..(706): Xaa can be any naturally occurring amino acid
HEEKRLSLLAKAQNRLAKLDELRQAAKNDVEMRFEKEREELETRVESRVRQAEENRMRLLHADMQKRAALKERTARSLVQKATSESKYMEQVRSAISQKRAAAEKKRLRLLEAEKTKAQARLLRIQKAAMTVCSQRESERRKLKEQLDNKLQRAKRQRAEYLKQRGSPRGSTHADYIKHADALSRKLARNWRIFVKSRKTTFALVQAYDALGINEKSVKSMPFEKLAMSMESPMVLQSTKALLDRLEKRLVISQSVASSSVXNVDHLLKRLGSPPRRKAPLSREGKTRAVVKRSAKSSEANSRLPRYSLRVVLCAYMILAHPSAVLSGQGERERQLIESAANFIKEFELLIKTILDGPGQSSDVTGQRKFRIQLANFDKAWCTYLYRFVVWKVKDARLLEEDLVRAACKLELSMMQTCKLTADGHSPNNLTHDMKAIQKQVTDDQKLLREKVQHLSGDAGLERMDSALLDTRSKFFEAKENGSPLAAPVANVSTPLSINSSVKVPLSEVNESSRTNAVGTSSVVRSLFGASSSVGSSPAKQPTENEQMVNEMLHEDASAFAGRSDSASTVEEEFQKKVRETMEKAFWDMVTNSMRGERPDYSQLINLVKEVRDSLHDLAPKEWKEKILENIDLEILSQVLGSGSQDAQYLGQILQYSLDMVRQLSAAAKEDEMKKNHDKLLSELSTNSEVNDNGINSFAIAVIKGXRFILEEIKELQAEVSKARVQMMQQIIKESAGVEYLQKAFADRYGPPENASASLPLTLQWIMTSNNIVEVEWSEHSDCLSIMQSAGQAPALVPVLRAGHGTLVGQPSSSAADTSVQPECKGEKLDKLIRIGLLQLISSMEGLQLQSIPESFQINLLRLRAVQSQFQQVIVIATSMLVLRQVLMSENSKATPLELENAISELFKALVNILDNSPDAGTEEIVQAMVNASASVGSPSEEKVQARMQMITRVFLKSLQPGDVVFKKVSRAVYCAFRGIILGGSGPKGQKLADAALRRIGAAKVMDRVLKAAEVLIKMATVSEKVHGPWYKALV

SEQ ID NO: 353 - protein, 1133 aa, Sorghum bicolor
LMMGAREPVAMEIPAEEGLAAAARAPPRRIRRRLVEGARGAGAPASVEEIEARLREAELRRQQFHEWLACKARKKPRSPSWSSQEEDHGQRLEAKLLAAEQKRLSLLAKAQNRLAKLDELRQAAKNDVEMRFEKEREELETRVESRVRQAEENRMRLLHADMQKRAALKERTARSLVQKATSESKYMEQVRSAISQKRAAAEKKRLRLLEAEKTKAQARLLRIQKAAMTVCSQRESERRKLKEQLDNKLQRAKRQRAEYLKQRGSPRGSTHADYIKHADALSRKLARNWRIFVKSRKTTFALVQAYDALGINEKSVKSMPFEKLAMSMESPMVLQSTKALLDRLEKRLVISQSVASSSVENVDHLLKRLGSPPRRKAPLSREGKTRAVVKRSAKSSEANSRLPRYSLRVVLCAYMILAHPSAVLSGQGERERQLIESAANFIKEFELLIKTILDGPGQSSDVTGQRKFRIQLANFDKAWCTYLYRFVVWKVKDARLLEEDLVRAACKLELSMMQTCKLTADGHSPNNLTHDMKAIQKQVTDDQKLLREKVQHLSGDAGLERMDSALLDTRSKFFEAKENGSPLAAPVANVSTPLSINSSVKVPLSEVNESSRTNAVGTSSVVRSLFGASSSVGSSPAKQPTENEQMVNEMLHEDASAFAGRSDSASTVEEEFQKKVRETMEKAFWDMVTNSMRGERPDYSQLINLVKEVRDSLHDLAPKEWKEKILENIDLEILSQVLGSGSQDAQYLGQILQYSLDMVRQLSAAAKEDEMKKNHDKLLSELSTNSEVNDNGINSFAIAVIKGLRFILEEIKELQAEVSKARVQMMQQIIKESAGVEYLQKAFADRYGPPENASASLPLTLQWIMTSNNIVEVEWSEHSDCLSIMQSAGQAPALVPVLRAGHGTLVGQPSSSAADTSVQPECKGEKLDKLIRIGLLQLISSMEGLQLQSIPESFQINLLRLRAVQSQFQQVIVIATSMLVLRQVLMSENSKATPLELENAISELFKALVNILDNSPDAGTEEIVQAMVNASASVGSPSEEKVQARMQMITRVFLKSLQPGDVVFKKVSRAVYCAFRGIILGGSGPKGQKLADAALRRIGAAKVMDRVLKAAEVLIKMATVSEKVHGPWYKALV

SEQ ID NO: 354 - protein, 862 aa, Nicotiana tabacum
MLGVDEKDRVPGGNRKTYARSVSWSDRSPTKSSAKPQWNSKARACLPPLQPLSITRPTAEEWPCAGSDDLGVWPNNPPTPGVRLGPVSTHVGSATKRVPREFEFKKDKLAFFNKECSKIVDHIYLGSDTVAKNRDILHENGITHVLNCVGFSCPEYFKDDLVYKTLWLQDSPTEDITSILYDVFDYFEDVREQGGRVFVHCYQGVSRSTSLVIAYLMWKEGLSFEDAFQHVKAARGVTNPNMGFACQLLQCQKRVHALPVSPSSVLRMYRMAPHSPYDPLHLVPKMLNEAGAEGFDSRGAFLVLIPSAIYVWIGKHCDSVMSDNARAAAFQVIRYEKAQGPVIIINEGKEPSDFWSALSHGSFFTGGCSKEKTKVEASLLDGTTGTITDNIIQYIGQQKVGEYDLDFEIFYKALAGGVVPPFPLSGTESEMRLPARENGWSRLRRKFSSGIMKEFITASKLYSHTGGQASPVLDKMDTSKEISPALPSSPSSPQCDSPDSFSSYATSSPSFRDVGNSGLDSEPLLSPSPSFSSLDSLSCFLVNKPKSDTTSPSLSPSTSDYSSSFTFSPSSSNWSDLAYLSAQPSPTRFEYEDPNFVKNDSFKESSSLLCKETSLPAEEAFPTCHTLGQANSCLLYKEAFPSLAERRGSHPPPRMMLRCNDDSTQISAKLVRTSSFSLPSFGDDTIKCLECDNLNDGDFADTSKEELMLDAESSITDNQLPNGVQPDDVSRSFYDHPIVVADTTDLGLYQWPSMHKLGLASGFFDSRSVYIIVIPDLNLDENSSNSLYIWVGRDVQWKESPNQVINNESMCEDGHVHWEKVGRRFLIQKGLATSSLVQIVKEGEEPEQLLKHLPCFSLEKTY

SEQ ID NO: 355 - protein, 862 aa, Nicotiana tabacum; identical to SEQ ID NO: 354

SEQ ID NO: 356 - protein, 277 aa, Saccharum officinarum
  misc_feature (248)..(248): Xaa can be any naturally occurring amino acid
  misc_feature (261)..(261): Xaa can be any naturally occurring amino acid
EQVGQGSCGTVYHAQWYGSDVAVKLFSKQEYSEEMIDTFRQEVSLMKKLRHPNIILFMGAVASPERLCIVTEFLPRGSLFRLLQKNTGKLDPRRRVYMAIDIARGMNYLHHCSPPIVHRDLKSSNLLVDKNWTVKVADFGLSRLKLETFLRTKTGKGTPQWMAPEVLRNEPSDEKSDVYSYGVILWELVTQKIPWDNLNTMQVIGAVGFMDQRLDIPSDTDPKWASMIESCWDSDPRKRPSFLELLDXLRDLQKQYSLQAXMQRNLSADVLLKGAVK

SEQ ID NO: 357 - protein, 234 aa, Saccharum officinarum
EQVGQGSCGTVYHAQWYGSDVAVKLFSKQEYSEEMIDTFRQEVSLMKKLRHPNIILFMGAVASPERLCIVTEFLPRGSLFRLLQKNTGKLDPRRRVYMAIDIARGMNYLHHCSPPIVHRDLKSSNLLVDKNWTVKVADFGLSRLKLETFLRTKTGKGTPQWMAPEVLRNEPSDEKSDVYSYGVILWELVTQKIPWDNLNTMQVIGAVGFMDQRLDIPSDTDPKWASMIESCWDR

SEQ ID NO: 358 - protein, 234 aa, Saccharum officinarum; identical to SEQ ID NO: 357

SEQ ID NO: 359 - protein, 589 aa, Gossypium hirsutum
MNLIVSHHRYRLAFGVFLLLELVVVMSQKRPQEDGKARPSEGNSPDQDKRRRVPTLRNVVQEVMKLQSVQHLLEPVLEPLIRRVVKEEVELALRKHLNNMKRNGGKEVNSSESRSLQLQFLNNLSLPVFTGARIEAEDCSTIKVAIVDALTGQIVTSGPESSAKIEVVVLEGDFDGDEEDNWAVEEFNNNIVKEREGKKPLLTGDSFLTLTEGIGLVGEISFTDNSSWTRCRRFRLGARVVDGSGGTRVREAKTESFIVRDHRGELYKKHHPPSLSDEVWRLEKIGKDGAFHKRLSRENINTVKDFLTMLCINPPRLRHILGTGMSAKMWEITVEHARTCVLDKRRHVYCPPGSQQKSGVIFNVVGQLTGLLSECQYLTTDKLSETEKIEAQNLVISAFEHWAEVISFDDEASLISSCSKLAKIPCTNSAKTENSNGSKVLASQKMDGYDYAQTSASSPDIISTIYSVWGMGGLEDYALHGIENPDLRYDQTLSYPGQVNNSLTCDADISQTFGDEDHLGYFDGDLHSQGLGLESQADLQTAVDGFLVQRKVADQAKSRWTKVFSVLKWFSIKRKVKEKFLGLRYGTGL

SEQ ID NO: 360 - protein, 235 aa, Brassica napus
  misc_feature (63)..(63): Xaa can be any naturally occurring amino acid
  misc_feature (140)..(140): Xaa can be any naturally occurring amino acid
  misc_feature (227)..(227): Xaa can be any naturally occurring amino acid
  misc_feature (231)..(231): Xaa can be any naturally occurring amino acid
METEKKNSKELGLNHLGFVRVAAIQVLVSLSNLYDYAKQNSGPLKPAVGKVEGAVTTVVTPVXNKFKDVPDTFLLFLDHKVGEVSNKFDKHAPPLAKQVVSQAHVLIQATTEKAQSFVKEARTGGPKAAFNYAATEYKYXVVTNSVKVWAKLNQYKPIHAVGNKALPLAANLSGMYNELVTNMTKTGYPVVGYLPLVPVDDIVKAYEREQDAAQKKGDTTTVTDGNXSSSXSDTD

SEQ ID NO: 361 - protein, 357 aa, Hordeum vulgare
  misc_feature (161)..(161): Xaa can be any naturally occurring amino acid
  misc_feature (186)..(187): Xaa can be any naturally occurring amino acid
  misc_feature (191)..(191): Xaa can be any naturally occurring amino acid
  misc_feature (194)..(194): Xaa can be any naturally occurring amino acid
  misc_feature (197)..(197): Xaa can be any naturally occurring amino acid
  misc_feature (199)..(199): Xaa can be any naturally occurring amino acid
MKRLMKIVRFGTLTTMDEQIQQATGEGDESATQIRSEYEAQVAAKKIFHNVAKPGSKYIYLADMMRFMRQEEAIKAMHLFEGAQEHCRVSRRSLKNWVVNAFRERKALALTLNDTKTAVNKLNQMCNIVVGLIVSALWLLILGIATTHFFVFISSQLLVAXFVFGNTMKTIFEAIIFLFVMHPFDXXDRCXIEXVQXVXEEMNIMTTVFLRYDNLKIYYPNSVLATKPIFNFYRSPDMGEGVDFSIHVATPMEKLTLMKERILRYIDSKKEHWYPGAMVVLRDVDETNKLKVSIWLRHTLNFQDMGMRFVRRELVLQEMIRVLRDLDIEYRMLPLDVNVRNTPPLQSTRMPTTWNYS

SEQ ID NO: 362 - protein, 564 aa, Populus trichocarpa
MSWCLKVSRIECNKMGCFTVLKCKKKRPEPSVSIKRVSPKEQIPTTLPEPQVPTRSLQSAPPSFRTRVKPVQPENKVPSNRARALSAPESLDAAEQDALASAEYDEQEESKNRIGISKEQRLPGPQPLPLPSPQGGAILKPMSSFKSVNSSGSLYASGPLPLPRSGTYSGTLRNFPYEEIQSACCNFSSDRCVSEGLSSIMFRASFGDDTASSKKFEASVIRLNPSPQGLKEFINEVNTLASLQHPNLCKLLGYNARDGSDQRMLVYERLYHGSLDRLLYGRSDGPPIDWNTRMKIALCAAQGLAFLHEEGPFQAMYNEFSTANIQIDKDFSAKLSGYGCVGHIPETEISNSTAAAANLSVETVERGLLTPKSNVWSFGIFLLELLTGRKNLDSRHPREERNLVKWTRPFLADDCRLSLIMDPLLKCRFPAKAARTLADIALRCLQKDPLERPTMRTIVEHLKVIQDMKYSSRFPLQEPAAVAGKQMSRSPSLNGIITPAPRLSFSPSPPSRARPSISPTRPRALPPSLPPRACSSTLSLEELERQESRKSSSSAVRRPGVEGF

SEQ ID NO: 363 - protein, 550 aa, Populus trichocarpa
MGCFTVLKCKKKRPEPSVSIKRVSPKEQIPTTLPEPQVPTRSLQSAPPSFRTRVKPVQPENKVPSNRARALSAPESLDAAEQDALASAEYDEQEESKNRIGISKEQRLPGPQPLPLPSPQGGAILKPMSSFKSVNSSGSLYASGPLPLPRSGTYSGTLRNFPYEEIQSACCNFSSDRCVSEGLSSIMFRASFGDDTASSKKFEASVIRLNPSPQGLKEFINEVNTLASLQHPNLCKLLGYNARDGSDQRMLVYERLYHGSLDRLLYGRSDGPPIDWNTRMKIALCAAQGLAFLHEEGPFQAMYNEFSTANIQIDKDFSAKLSGYGCVGHIPETEISNSTAAAANLSVETVERGLLTPKSNVWSFGIFLLELLTGRKNLDSRHPREERNLVKWTRPFLADDCRLSLIMDPLLKCRFPAKAARTLADIALRCLQKDPLERPTMRTIVEHLKVIQDMKYSSRFPLQEPAAVAGKQMSRSPSLNGIITPAPRLSFSPSPPSRARPSISPTRPRALPPSLPPRACSSTLSLEELERQESRKSSSSAVRRPGVEGF

SEQ ID NO: 364 - protein, 468 aa, Saccharum officinarum
  misc_feature (23)..(23): Xaa can be any naturally occurring amino acid
SRAGTREGGYPSISRPCRSCSSXGFSPRSLFQRSAGTSSPRLSAVQYSGDKMKISLFLVPLLITLLSPNGPLPSAVALNVKGRLVKTKTFLSPPIFLRPGDVADKYYYDIAFPRGHLALKSFNGEVVDENGVPVPLHETYLHHWVVEPYYAAKDATAAAAEGRPRKLPARNSGVCNHTLGQYYGLGSETRRTATWVPDPYGIEIGDPDAAPEGYEERWFLNVHAIDTRRVVDKLACTECRCDLYNVTVDQHGRGLPGDYAGGLRCCYDETRCAVEEGAFAVNGGEPRKVFLRYTVMWQDWSDAAVLPVKIYIFDVAACKVEYQVEECAGAGNDGGECVHVQTATQVLPRGGDVVFGVAHQHSGGIGASLHGDDGRLLCESTATYGEGQEAGNEAGYIVGMSTCYPKPGDVKVRDGEALTVVSRYSSERRHTGVMGLFYILVAEHQQQPGLCFSFPVSWCLPSWLSSNL

SEQ ID NO: 365 - protein, 468 aa, Saccharum officinarum; identical to SEQ ID NO: 364
  misc_feature (23)..(23): Xaa can be any naturally occurring amino acid

SEQ ID NO: 366 - protein, 622 aa, Hordeum vulgare
  misc_feature (84)..(84): Xaa can be any naturally occurring amino acid
  misc_feature (238)..(238): Xaa can be any naturally occurring amino acid
PSPKTNGINHGLGPLRLRSPTSSPLPFLPSPPLQPPPPQAKRRHRMAASPTPGGGGIGAILAAGDRDYLVRNSGEQVKISGIEXDTVALYFSASWCPPCRRFTPKLIEAYKELTSLGKSFEVVFVSGDQDEEAFNAYFAKMPWLAVPFSDSEGRKNLDERFEVNGIPHLVFLDAKTGEVLTDEGVEFVSEYGIEAYPFTTERINELKEQEKAAKDNQTIHSVLGTANRAYVISNTGKXVPIVDLEGKYVGICFVVNGYPPVEEFTSVLAKIYAKLKEVGEKFEVVAVSLDSDEESFNTSFSSMPWLAIPQGDKMCQKLVSYFELSDLPTLVLIGPDGKTLSSNIAGIIDEHGLDAWEGFPFSAEKLEILAEKAKAKAASQTLESLLVTGDLDFVIGKDGAKVPVAELVGKTVLLYFSAKWCGPCRAFLPTLVDVYNKIKEKNSDFEIVFISSDKDQSSFDDFFSGMPWLAIPLEDERKADLKKRFKIRGIPSLVAIGPDGKTVNTDAKTSLAVHGADAFPFTDERIEELEKKIDEMAKGWPEKLKHELHEHELVLVRRRRPYGCDGCEEMGNSWSYNCAECDFDLHTKCALGEEKKGEEVKGQEDAAAPAGYVCEGDVCRKA

SEQ ID NO: 367 - protein, 577 aa, Hordeum vulgare
  misc_feature (39)..(39): Xaa can be any naturally occurring amino acid
  misc_feature (193)..(193): Xaa can be any naturally occurring amino acid
MAASPTPGGGGIGAILAAGDRDYLVRNSGEQVKISGIEXDTVALYFSASWCPPCRRFTPKLIEAYKELTSLGKSFEVVFVSGDQDEEAFNAYFAKMPWLAVPFSDSEGRKNLDERFEVNGIPHLVFLDAKTGEVLTDEGVEFVSEYGIEAYPFTTERINELKEQEKAAKDNQTIHSVLGTANRAYVISNTGKXVPIVDLEGKYVGICFVVNGYPPVEEFTSVLAKIYAKLKEVGEKFEVVAVSLDSDEESFNTSFSSMPWLAIPQGDKMCQKLVSYFELSDLPTLVLIGPDGKTLSSNIAGIIDEHGLDAWEGFPFSAEKLEILAEKAKAKAASQTLESLLVTGDLDFVIGKDGAKVPVAELVGKTVLLYFSAKWCGPCRAFLPTLVDVYNKIKEKNSDFEIVFISSDKDQSSFDDFFSGMPWLAIPLEDERKADLKKRFKIRGIPSLVAIGPDGKTVNTDAKTSLAVHGADAFPFTDERIEELEKKIDEMAKGWPEKLKHELHEHELVLVRRRRPYGCDGCEEMGNSWSYNCAECDFDLHTKCALGEEKKGEEVKGQEDAAAPAGYVCEGDVCRKA

SEQ ID NO: 368 - protein, 228 aa, Hordeum vulgare
MTTAARPTWAPAKGGNEQGGTRIFGPSGKYSSRDLAAHTSLKPRKEGQQTQEEVQKRNLRDELEERERKHFSSKDKSYVDERDRRKSSSLLLEGSKRDEDKIVPREIDADDSDVELKSDDESDDDDDDDDTEALMAELERIKKERAEDRLRKERQQAEEEAKMKEAELMRGNPLINMNNSGSFNVKRRWDDDVVFKNQARGETKTPKRFINDTIRSDFHRKFLHRYMK

SEQ ID NO: 369 - protein, 228 aa, Hordeum vulgare; identical to SEQ ID NO: 368

SEQ ID NO: 370 - protein, 571 aa, Vitis vinifera
MDEDFDIPAAEEMNDDMDLPDESPILKVGEEKEIGKQGLKKKLVKEGEGWDTPENGDEVEVHYTGTLLDGTQFDSSRDRGTPFKFTLGQGQVIKGWDQGIKTMKKGENAIFTIPPELAYGESGSSTTIPPNATLQFDVELLSWTSVKDICKDGGIFKKIVTEGDKWENPKDLDEVFVKYEARLEDGTLVAKSDGVEFTVKEDYFCPALSKAVKTMKKGEKVILTVKPQYGFGEKGKPASGEEGAVPPNATLEITLELVSWKTVTEVTDDKKVIKKILKEGEGYERPNEGAVVKLKLIGKLQGGTVFLKKGHGEGEDLFEFKTDDEQVIDGLDRAVMTMKKGEVALLTIHSDYAFGSSESSQELAVVPPNSTVYYEVELESFVKDKESWDMNTEEKIEAAGKKKEEGNVLFKAGKYARASKRYEKAAKYIEYDSSFGEEEKKQAKTLKVTCNLNNAACKLKLKDYKEAEKLCTKVLDIQSKNVKALYRRAQAYIHLADLDLAEFDIKKALEIDPDNRDVKLEYRTLKEKMKEYNKKEAKFYGNMFARMNKLEALETNKATKEAEPMSIDSKA

SEQ ID NO: 371 - protein, 414 aa, Populus trichocarpa
MERFLLAVDTMGANQVGGGQTLLGTIKIAVLPIAKVFTMCFLGFLMASKYVNILPASGRKLLNGLVFSLLLPCLIFSQLGQAVTLQKMLEWWFIPVNVVLSSICGSLIGFIVASIVRPPYPFFKFSIVQIGIGNIGNVPLVLIAALCRDTSNPFGDSEKCSTDGTAYISFGQWVGAIILYTYVFNMLAPPPEGTFDIDEPNLPIKKPAKDAPMEQVPLLAQEEAPAEPDAPKRGKIKQILVFLYDKLKLKQILQPPIIASILAMFLGAVPFLKQLIFTTDSPLFFFTDSCNILGEAMIPCILLALGGNLVDGPGSSKLGFRTTAAIIFGRLVLVPPTGLGIVMLADKLGFLPAGDKMFRFVLLLQHTMPTSVLSGAVANLRGCGREAAAVLFWVHIFAIFSMAGWIVLYLNILF

SEQ ID NO: 372 - protein, 414 aa, Populus trichocarpa; identical to SEQ ID NO: 371

SEQ ID NO: 373 - protein, 159 aa, Brassica napus
MQSMKETASNIAASAKSGMDKTKATLEEKAEKMTTRDPLQKEMATQKKEGRINEAEMQKREAREHNAVMKEASGAGTGTGLGMGTATHSTTGHVGHGTGTHQMSALPGHGTGQPAGHVVDGTAVTEPIGTNTGTGRTTAHNTRVGGGTTGYGTGGGYTG

SEQ ID NO: 374 - protein, 159 aa, Brassica napus; identical to SEQ ID NO: 373

SEQ ID NO: 375 - protein, 496 aa, Vitis vinifera
  misc_feature (50)..(50): Xaa can be any naturally occurring amino acid
  misc_feature (263)..(263): Xaa can be any naturally occurring amino acid
  misc_feature (368)..(368): Xaa can be any naturally occurring amino acid
MARKMLIDGELSKPNEEETHYDFDLFVIGAGSGGVRAARFSANFGAKVAXCELPFHPVSSEVIGGVGGTCVIRGCVPKKILVYGASFRGEIEDAKNYGWELNDKVDFNWKKLLHKKTEEIVRLNGIYKRLLTNAGVKLYEGEGKIVGPNEVEVTQLDGTKLCYSAKHILIATGSRAQRPTIPGQELSITSDEALSLDELPKRAVILGGGYIAVEFASIWNGMGVAVDLFFRKELPLRGFDDEMRAVVARNLEARGINLHPRTXLSELVKTEDGIKVITDHGEELTADVVLFATGRAPNTKRLNLEVVGVELDKMGAVKVDEYSRTNIPSIWAIGDVTNRMNLTPVALMEGTYFAKTVFGGQPSKPDYXDIPCAVFCLPPLSVVGLSEEQATDQAEGDILVFTSTFNPMKNTISGRQEKTIMKLLVDAETDKVLGASMCGPDAPEIMQGIAVALKCGATKAQFDCTVGIHPSAAEEFVTMRSVTRRIAAGNKPKTNL

SEQ ID NO: 376 - protein, 496 aa, Vitis vinifera
MARKMLIDGELSKPNEEETHYDFDLFVIGAGSGGVRAARFSANFGAKVAICELPFHPVSSEVIGGVGGTCVIRGCVPKKILVYGASFRGEIEDAKNYGWELNDKVDFNWKKLLHKKTEEIVRLNGIYKRLLTNAGVKLYEGEGKIVGPNEVEVTQLDGTKLCYSAKHILIATGSRAQRPTIPGQELSITSDEALSLDELPKRAVILGGGYIAVEFASIWNGMGVAVDLFFRKELPLRGFDDEMRAVVARNLEARGINLHPRTTLSELVKTEDGIKVITDHGEELTADVVLFATGRAPNTKRLNLEVVGVELDKMGAVKVDEYSRTNIPSIWAIGDVTNRMNLTPVALMEGTYFAKTVFGGQPSKPDYKDIPCAVFCLPPLSVVGLSEEQATDQAEGDILVFTSTFNPMKNTISGRQEKTIMKLLVDAETDKVLGASMCGPDAPEIMQGIAVALKCGATKAQFDCTVGIHPSAAEEFVTMRSVTRRIAAGNKPKTNL

SEQ ID NO: 377 - protein, 151 aa, Gossypium hirsutum
MSQLLEKAKDFVVDKVANIKKPEASVSDVDLKHVSRECVEYGAKVSVSNPYSHSIPICEISYNFKSAGRGIASGTIPDPGSLKASDTTMLDVPVKVPYNILVSLVKDIGADWDIDYELELGLTIDLPIVGNFTIPLSQKGEIKLPTLSDIF

SEQ ID NO: 378 - protein, 151 aa, Gossypium hirsutum; identical to SEQ ID NO: 377

SEQ ID NO: 379 - protein, 497 aa, Hordeum vulgare
MARKVLKDGEAPVAAADDGGSYDYDLFVIGAGSGGVRGSRTAAGFGAKVAICELPFHPISSEWLGGHGGTCVIRGCVPKKILVYGASFRGEFDDASNFGWEINGDINYNWKKLLENKTQEIVRLNGVYKRILGNSGVTMIEGAGSIVDAHTVEVTQPDGSKQRHTTKHILIATGSRATLVNIPGKELAITSDEALSLEELPKRAVILGGGYIAVEFASIWKGLGAQVDLFYRKELPLRGFDDEMRTVVASNLEGRGIRLHPGTNLTELSKTADGIKVVTDKGDELIADVVLFATGRAPNSNRLNLEAVGVEVDQIGAIKVDEYSRTSVPNIWAVGDVTNRINLTPVALMEATCFAKTVFGGQTVKPDYKDVPCAVFCIPPLSVVGLSEQEALAEAKNDLLVYTSSFNPMKNSISKRQEKSIMKLVVDAETDKVLGAAMCGPDAAEIMQGIAVALKAGATKATFDSTVGIHPSAAEEFVTMRTLTRRVSPASKPKTNL

SEQ ID NO: 380 - protein, 497 aa, Hordeum vulgare; identical to SEQ ID NO: 379

SEQ ID NO: 381 - protein, 110 aa, Saccharum officinarum
MRPLLVLALIFVIAGVAHGAGECGRASADRVALRLAPCISAADDPQSTPTSSCCSAVHAIGQSPSCLCAVMLSGTARAAGIKPEVAITIPKRCNMADRPVGYKCGDYTLP

SEQ ID NO: 382 - protein, 110 aa, Saccharum officinarum; identical to SEQ ID NO: 381

SEQ ID NO: 383 - protein, 210 aa, Saccharum officinarum
APAHVWRFSLRYCRLSRVPTTVLRSPPRILRPPAMETCPSVKNILLLDSEGKRVAVKYYSDDWPTLTAKLAFEKSVFAKTQKANAGTEAEIVMFDGQIVVYKFIQDLHFFVTGGEEENELILASVLQGFSDAVERLLKNMVDKRTALENLDLILLCLDEIVDGGIVLETEGREIAEKVSGHGLEGASSAEQTLVNALTQAREHFAKSLLM

SEQ ID NO: 384 - protein, 143 aa, Saccharum officinarum
APAHVWRFSLRYCRLSRVPTTVLRSPPRILRPPAMETCPSVKNILLLDSEGKRVAVKYYSDDWPTLTAKLAFEKSVFAKTQKANAGTEAEIVMFDGQIVVYKFIQDLHFFVTGGEEENELILASVLQGFSDAVERLLKLFSLY

SEQ ID NO: 385 - protein, 75 aa, Hordeum vulgare
MADTAKADAAAEAAKMDLLEDDDEFEEFEIDQEWDDKEEGNEAVQQWEDDWDDDDVNDDFSLQLRKELESIPSKN

SEQ ID NO: 386 - protein, 75 aa, Hordeum vulgare; identical to SEQ ID NO: 385

SEQ ID NO: 387 - protein, 383 aa, Hordeum vulgare
  misc_feature (61)..(61): Xaa can be any naturally occurring amino acid
MAAAVFAGDGAAARGGCSAECAGGIERPPDLGSRAGDGCGKRSVYLMECVPLWGCAAARGXAAEMEDACAAVPRFAALPARMLASSRELDGIGGDFDAAELRLPAHLFGVYDGHGGSEVANYCRDKVHVVLREVLRDGRGLEELGEVGEVDVKESWEKVFGDCFQKVDDEVSGKAIRFSNGVTELRPEPIAADNVGSTAVVAIVCSSHVITANCGDSRVVLCRGKEPIALSVDHKPDRKDERARIEAAGGKVIDWNGYRVSGILAMSRSIGDRYLKPFLIPKPEVSVVPRAKDDDCLILASDGLWDVMSNEDACKVARRQILLWYKNNNDGANSDGGSEPTMNPAAKAAADCLVRLALMKGSGDNISVIVIDLKSRKKPKGKS

SEQ ID NO: 388 - protein, 383 aa, Hordeum vulgare
MAAAVFAGDGAAARGGCSAECAGGIERPPDLGSRAGDGCGKRSVYLMECVPLWGCAAARGRAAEMEDACAAVPRFAALPARMLASSRELDGIGGDFDAAELRLPAHLFGVYDGHGGSEVANYCRDKVHVVLREVLRDGRGLEELGEVGEVDVKESWEKVFGDCFQKVDDEVSGKAIRFSNGVTELRPEPIAADNVGSTAVVAIVCSSHVITANCGDSRVVLCRGKEPIALSVDHKPDRKDERARIEAAGGKVIDWNGYRVSGILAMSRSIGDRYLKPFLIPKPEVSVVPRAKDDDCLILASDGLWDVMSNEDACKVARRQILLWYKNNNDGANSDGGSEPTMNPAAKAAADCLVRLALMKGSGDNISVIVIDLKSRKKPKGKS

SEQ ID NO: 389 - protein, 388 aa, Solanum lycopersicum
MGRRSSQRRNAAMLDSDDTDSLSSSSTTRSDMMLSGLEEVQFDKETVLDQCVDALYEKRGSTREKALTSIIEAFNSNIQHEFVEKKFATLLQLCLSSIRRGSSKEIALASHVIGLLALTAGPGDKAHEILEESVKPISVALKSRSDNSKISSLLECLAIITFVGGKEPEETEESMQLMWQVINPKLGPNVATAKPSPVMITAVVSSWSFLLTTMDGWTLNPKSWQGSISYFSNLLDKEDRSVRIAAGETLALVFEVGSLEKFSGESKESSDSSADETNKSRELLHIQGLRAKVLNQVRTLSAEAGGKGSAKKDLNNQRNTFRDILEFLEDGYSPETSVKIGGLLLSTSTWAHLIQLNFLKHFLGGGFVKHMQACFLIKRSSFWAIGII

SEQ ID NO: 390 - protein, 440 aa, Solanum lycopersicum
MGRRSSQRRNAAMLDSDDTDSLSSSSTTRSDMMLSGLEEVQFDKETVLDQCVDALYEKRGSTREKALTSIIEAFNSNIQHEFVEKKFATLLQLCLSSIRRGSSKEIALASHVIGLLALTAGPGDKAHEILEESVKPISVALKSRSDNSKISSLLECLAIITFVGGKEPEETEESMQLMWQVINPKLGPNVATAKPSPVMITAVVSSWSFLLTTMDGWTLNPKSWQGSISYFSNLLDKEDRSVRIAAGETLALVFEVGSLEKFSGESKESSDSSADETNKSRELLHIQGLRAKVLNQVRTLSAEAGGKGSAKKDLNNQRNTFRDILEFLEDGYSPETSVKIGGLLLSTSTWAHLIQLNFLKHFLGGGFVKHMQENEFLHDVFGFTPKKNLPASQHRVSGTDKRKYKSPNSILNKARTQFLNKQRMLSQDKNVGYYEGGDEF

SEQ ID NO: 391 - protein, 388 aa, Solanum lycopersicum; identical to SEQ ID NO: 389

SEQ ID NO: 392 - DNA, 1068 bp, Malus x domestica
ttcagaagatgtgatattttccttcagacaagaggtgtctctcatgaataggcttcgacatccaaatgttctgctttttatgggagctgtgacttcacctcagcgtctctgcatcgtaactgaattcctccctcgtggaagtttgtttcgcttattacaaaggaacacatcaaaactagactggaggcgacgtgttcttatggcgatagatatagcacgaggcatgaattatcttcatcatttcaacccacctatcattcatcgagatctgaagtcttcaaatctcctagttgataggaactggacggtcaaggttggtgattttggtctttcacgtcttaagcacgaaacatttctcacaaccaagaccgggaagggcacgcctcaatggatggcaccagaagttctacgtaatgaaccctcagacgagaagtctgatatatacagctatggggtgatattgtgggagcttgctactgagaagatcccttgggataatctgaactcaatgcaggtgattggagctgtagggttcatggaccaaaggttagagatcccaaaggatgtggacccacaatggacttctttgattgagagctgctggcagagtgatgcagctgccaggccaacatttcaagaaytgctggagaggctcagagacctgcagagacagtacaatcttcagttccaagcagcgcgtaccgccatgggtgataacgccccgaaagaattgtagcccctcccggccggatctttatgttgcatcagtgttctcacttccctaccactgtggatgaatcgaagcagagcagtgacaaaacgggtaaattagccagagacagcccccaaatggcatgtcgtattggaaccacaaagttggaaagtcagatggcacaaacggcatgtcgtattaaaacggttgatgggtttggttgtgtgatggttaatgtgtgggtgtagtgcgagagggagtcatgtcggttggattggatcacatgataatatgtcaccagtttttgtgatttataaaaaaatgtaaaaaaatatgagggaaacaaaaaaaaaaaa

SEQ ID NO: 393 - DNA, 1981 bp, Malus x domestica
gattacttccttcsaaytmmrywgcgwcgcgattccctcggactctgcaaacaagaacaatcaccctcccatcccttcctcctacatcgttgcttaaccatctctctcctctctctctctctctctctctctctgccggtccgaaccccagaagaagccaagccacactagtcgcatcgccatctccgacttcactccgattcagttggatttactctgttatcatgtcgaggaagatgctaattgatggtgaggtgaaccaacctaatgaacaagaggcccactacgacttcgacttgtttgttattggggccggaagcggtggtgtccgtgcytccagattttcagctaattttggagctaaggttgggatatgcgagcttccatttcatcctgtcagctcagaagtaattggaggagtgggtggaacatgtgtcattcgtggttgtgttcccaaaaagattttggtgtatggagcgtcttttggtggtgaaattgaggatgccaggaattatggctgggaagtgaatgagaaagttgatttcaactggaagaaacttttgcagaagaagacggatgaaatagttcgattaaatggaatatacaagcgcctattgtcgaattctggggttaaattctttgaaggagagggcaagatagttggtcctaatgatgtcgaggtgacacagttggatggcactaaattgagctattctgcgaaacacatattgattgcaactggcagcagggctcaacgacctgctattcctggtcaggaattgggtatatcatctgatgaagcattgagtttggaggaattacctaaacgtgctgtggtgctcgggggagggtacattgctgttgagtttgcttcaatatggcgtgggatgggtgcttctgtggatctattcttcagaaaggaacttccattgagaggttttgatgatgaattgagggcagtggttgcacggaatctggaaggaaggggtattgatctacacccgcagacaaatttgacagagctagtaaaaacagaggatggcataaaagttcgcacagatcatggggaagagctgatagcagatgttgtactgtttgccactggtcggtctcccaatacaaagaggttgaatttggcagctgtaggcgtggaagttgataaaacaggagctataaaggtggatgagtattcacgtaccaatgtacctagcatctgggctgttggcgatgttacaaaccgagtaaaccttacccctgtggctctaatggagggaacatgcttcgcaaaaacagtttttggtggggaacctagcaaaccagattaccgcgatataccctgtgcagtgttttgcataccacctctttctgttgtgggccttactgaagagcaggcaatagaacaagccaagggtgatatattggttttcacatcaactttcaacccaatgaagaacactgtatctggacgacaagaaaagacaattatgaagcttattgttgacgctgagacggataaagttattggggcatccatgtgtgggccagatgcagctgagattatgcagggaatcgctattgcattgaagtgcggagcaaccaaggcacaatttgacagtacggtgggaattcacccttcctcagcagaggagtttgtgacaatgcgttcagcgacaaggcgtattgctgcaggtaccaaaccaaagacaaatctgtaggatgcgaacaacagacggaaagaatagtatacaaggtctggaggagactgttttgctcttaccagaggaaacttaggaatatttgggaaatggaaatcggttgaattttgtcagaataaaagcttcttcgaactcatatctgattagggccgtataggttttctgatgatttatgaagatacaaaattgttgtattcatacacatacactgcttcgatccaacatttgatatctatgattttgttgctgtgttttaaaaaaaaaaa

SEQ ID NO: 394 - DNA, 1292 bp, Malus x domestica
aatggccgggggatcctgatgataaaggcattcaaacatataatgatgccaagcattttgccatatctgctaaagtacctgagttcagcaacaaaaatagaactctagttgtccagtattcaattaaatttgagcaagacatagaatgtggtggtggttacatcaagcttctctctagctatgtcaatcagaagaagttcggtggtgataccccgtacagtttcatgtttggaccagatttatgtggcacacagacaaaaaaactccatgttatactttcctaccaggggcagaattatcccataaaaaaggatctccaatgtgaaacagacaagttaactcatttctatacatttattcttaggcctgatgcaacttacagcgtccttgttgataatcgagagagagattctggaagcatgtatacagattgggatatccttcctccaaaaaaaataaaggatgtgaacgcaaaaaagccagccgactgggatgacagagagtatattaatgaccctaatgaagtcaaaccggagggctatgattcaattccatctgaaattcctgatccaaaagccaaagagcccgaagactgggatgaggaagagaatggaatttggaggcgatcaaagatcccaaatccagcatacaaaggaccatggaagcgcaagaaaatcaagaaccccaactataagggaaagtggaagactccatggattgataacccggagtttgaggacgatcctgacctatatgtgctgaagccaattaaatatgtgggcattgaagtttggcaggtgaaggctggttcagttttcgacaacattttaatttgtgatgatccacagtatgcmaaagaagttgtagaagaggttttttccaatagagacgctgagaaagaagcttttgaggaagcagagaagcagaggaaagctcgagaagaagaggaggctaaaagagcgagagaggaaggtgaaaaaaggaagagggagagggatcgcgaatatggcagggataggaggcgccgtagaaggcatgatccccatgattatctggatgattaccatgatgaactgtgaggaggcaggcaccascarcagawgttcgctaggtgtatttcgggtgtgggaagcatttccaattgttagagaagcatgttttatctcgtccgttggacatgccttgtgtgttgtacaattgtttaaacatcaaaattaaacccttattaactgccaattttgggttcaaaagaaccattarcagcatttagtggtggattgaaaaccctcgtg

SEQ ID NO: 395 - DNA, 2123 bp, Malus x domestica
tggggaggttcgtggtggagaagaacagcttgaaggtgacttctccaagctcgatgaagggcttgtacgaatgtgcgattgggaactttggggttcctcaatacggaggaacgttggtcggaactgtgtactatccgaagaccaatcagaaggcatgcaaagggtttgaagatttcgatgaatccttcaaaccgaagcccggtggtctgccgacgtttctgcttgtcgatcgaggagattgttacttcacattgaaggcatggaatgcacagaaagggggagcggctgctattcttgttgcagatgacaggaatgaaccgttgattaccatggacaatcctgaagaagaaaatgcggatgctgattatctgcagaaaatcacaattccctcggctctcattagcaaagagttgggagaaagtataaaaaaatctctatcaggtggggagatggtcaacataaatctagactggacagaggctcttccacatcccgatgaacgtgttgagtatgagttctggacgaatagcaatgatgagtgtgggccaaagtgtgatagccagattgagtttgtgaaaagctttaaaggagcagctcaggttcttgagcggaaggggtacacccagtttactccacactatataacctggtactgtccagaagcttttgttttgagcaaacagtgcaagtctcagtgcatcaaccatgggaggtactgtgctccagatcccgagcaagatttcagtaaaggttatgatgggaaagatgttgtggttcaaaatctccgccaagcttgcttatataaagtggccaatgaaagtggaaagccatggctttggtgggactatgtaactgactttgcgatacgttgcccaatgaaagataagaagtacaccgaagagtgtgcaaatcaagttattgaatcccttggtgctgatcttaagaatacagaaatgtattggcgaccctgaagcggatgaggagaatgcagttctgaaggccgaacaggatgcacagattggcaaaggcacccgtggagatgttacgatattgccaactcttgtaataaacaacagacagtatagagggaaactggacaaaggagctgttctcaaagccatctgtgctggtttccaagagaccactgagccctctgtttgtttaagtgaagatgtacagacaaatgagtgtttagagaacaatggaggttgctggcatgacaaagctgctaacattaccgcgtgcagggatacattccgcggaagagtgtgcgaatgccctattgtgcaaggcgtaaagtttgttggtgatggttatactcactgtgaagcttcaggagcattacgttgtggaataaacaatggaggttgttggaaggaaacccgatctggcaggacttactctgcatgtcgtgatgaccatacaaatggttgcagttgtccaccaggattcaagggtgatggagagaaaacatgtgaagatgttgatgagtgcaaggagaaaacggcttgccaatgttcacaatgcaaatgcaagaatacttggggaagttacgagtgcagttgcggtggcggtttactgtacatgcgagaaaatgatgcatgtataggtaaaaacggaagtggttctgggtctagctggggcctaatttgggttatcattctctgcttgggtgctgtcggagttgggggcttcgcagtttacaagtaccgaatccggagatacatggattcggagatccgggcaatcatggcgcagtacatgccgttggataatcaaggagaagttccgagccacgtcgcccgcggggatatctgaaaccggcggagagacgtattcataagacataagatgctgtccgagagaaaagggaagacaaccaacgtcctgaaatcctatgtcctcctctcgcctctaggcgctggcaatttgtttcatttcgcgtgagattgtaacgttttagatgtgcatctagcgtttcacactatatattctagtaggaaacattagataccaactagtttttttattcaaagtaataaacattttaccgttggaatcagcattttttttcactctctgaagcaaagttgatcgtttgtttttttctagtttataaggtt

SEQ ID NO: 396 - DNA, 1150 bp, Malus x domestica
aattcggcacgacgcgccgcttccttagctcccgttttcgccccaattctcaattcctgtgccccgaacaccaattttccttctatttccttgaaattcgtgtcgggattttatcgggaaaagtagggttagggtcggggagggacaaaaaagatgagctttcgggatctggaagcgggtcggggcaccaattattcccggcgaggagacctcatcaatggcaagcgggaccccacccaagctgtggcctccggcattttccagatcaacaccgccgtatccaccttccagaggctcgtcaacaccatcggcacccccaaagacacgccggatctccgcgaaaagctgcacaagacragactacatatygggcaattggtgaaggatacttcagaaaaacttaaacaagtcagcgaaagagatcatcatactgaagttaatgcaagcaagaagattacagatgctaagcttgcaaaagattttcaagcagtgctgaaagaatttcagaaggctcaacgacttgcagctgagagggaaacarcatatgctccttttgttcctcaagcagttcttccgacaagttacaccgctagcgagatagatgtaaactcagacaaaagtctggaacagcgtgctctccttgtggaatctagaagacaagaggttgtgctattggacaaygagattgcyttcaatgaggctatcatygaggaaagagaacagggaatacaagaaatccagcagcarattggtgaagtgaatgakatttttaaagatcttgctatactggttcatgarcaaggaacmatgattgatgacattggctccaatattgagggtgctcatgctgcaactgggcaggcgaagtcccaacttgtgaaggcatcaaagacccaaagatcaaattcgtctctgacttgcttgctcttggtaatatttggaattgtgcttctcatcgtgatagtagtacttgcagcttaaycaraagattgtctaaactcaatgacagcraactaaagattgtgatacgcatccctctgctatttctgcgatgcctgactagagtttgccgttgtattctatgttcgtatataggggtgggtatcctttgcaatttctggttgcggttgggtgaggtgtctgttctgtt

SEQ ID NO: 397 - DNA, 1555 bp, Malus x domestica
actcagcgtcccttcaaaagcttgacctatcagcgccacccacgtgtagtacaatcaacgtgccggcaccggcttcccttccatagctccaccaggaaaaaccacctcaccgcgtcaaaaataccttctctctctctctctctctctctcctctttctctccctccctccccaaaaatctcctggtgcgtagctgcccttttcgccccaattctcaattcgcatcgaggtccttgaagatccctgtacccaaacaccaactttccttctacgtcctcgaaattcgcgtcgggattttctcgggaaagtaagggctagggtttgggagggaaacaacaagatgagctttcgggatctggaagcgggtcggggctccaattattcccggcgaggagacctcggcactggaaagcaggatcccacccaagctgtggcctccggcattttccagatcaacaccgccgtatccaccttccagaggctcgtcaacaccatcggcacccccaaagacacgccggatctccgcgaaaagctgcacaagacragactacatatygggcaattggtgaaggatacttcagaaaaacttaaacaagtcagcgaaagagatcatcatactgaagttaatgcaagcaagaagattacagatgctaagcttgcaaaagattttcaagcagtgctgaaagaatttcagaaggctcaacgacttgcagctgagagggaaacarcatatgctccttttgttcctcaagcagttcttccgacaagttacaccgctagcgagatagatgtaaactcagacaaaagtctggaacagcgtgctctccttgtggaatctagaagacaagaggttgtgctattggacaaygagattgcyttcaatgaggctatcatygaggaaagagaacagggaatacaagaaatccagcagcarattggtgaagtgaatgakatttttaaagatcttgctatactggttcatgarcaaggaacmatgattgatgacattggctccaatattgagggtgctcatgctgcaactgggcaggcgaagtcccaacttgtgaaggcatcaaagacccaaagatcaaattcgtctctggtaatttattcacatttattttatgacattttacatatatttgtatatatatttttccaaatgttctcttctttcagttgtatatatactttctgacattttatatgtatttgtatatgtatatttttccaaatgttctctcagttcctttacaaatattttaaccaatcacttttaagtttgtttaatcatwsttatcwttttttgttttytgcatagacttgcttgctcttggtaatatttggaattgtgcttctcatcgtgatagtagtacttgcagcttaaycaraagattgtctaaactcaatgacagcraactaaagattgtgatacgcatccctctgctatttctgcgatgcctgactagagtttgccgttgtattctatgttcgtatataggggtgggtatcctttgcaatttctggttgcggttgggtgaggtgtctgttctgtt

SEQ ID NO: 398 - DNA, 2058 bp, Malus x domestica
caaaacccttgcagaaggctctagaactcgaaaagttcacaccataaaagcctcgtcttcctcagtctcacactcacccaattttcttcaatctcagaatctcgtaatacgcattcgaaaccgttgaatttatcatctcgctttctcgataaaatggacgaggacttcgacatgccggcggcggaggagatgaacgaggacttcgatctccccggtgaggggccggcactcaaggtcggcgaggagaaggggatcggcacccagggcttgaagaagaagctccttaaggaaggcgaaggctgggacaaccccaagaatggcgacgaggtcgaagttcattatactgggacattgctggacgggactaagtttgattcgagccgggacagggggactccgttcaagttcactctcggacaagggcaagtgattaagggatgggatgaaggtattagaacgatgaagaagggcgaggatgccctttttaccattccccctgagttggcttatggcgagtctggatcacctccaaagatccctcccagcgctacattgcaatttgatgttgaattgctatcgtggaccagtatcaatgacataagcaaggatggtggtataatcaagaagatcctgaaagagggagaaaagtgggagaacccaaaagacctcgatgaagttatagttaattttgaggcgcagcttgaagataaaacacttgttgcaaaatatcaagctgtggaattcaccgtcaaagacggttacttctgtcctgcaatatcaaaggctgttaaaacaatgaagaagggggagaaggtactattaacggtgaaaccacaatatggatttggggacaagggaaagcctgcctctggctctgagggtgcagttcctccaaacacaactcttcatatcactttagagttggtatcatggagaactgtgtctgaagtgacagatgataagaaggttattaagaagatcttgaaagaaggggagggatatgagcgtccaaatgaaggggctgttgttaaattgaaattgactgggaagctgcaagatggaaaggaatttttgaagaaaggtcatgttgaaggagaagacctgttcgagtttaagacagatgaagagcaagtgattgatgggcttgatagagctgtacagacaatgaagaagggtgaggtagcactcctgactattgcaccagagtatgcatttggctctgtggagttccagcaggagttggctgtggtacctcctaattcaactgtcaactatgaggttgagcttgtatcttttgagaaggataaggaatcatgggatatgaatactgaggaaaaaattgaagctgcgggtaagaagaaggaagaagggaatgctttgtttaaggcgggtaaatatgcaagagcttccaagagatatgagaaggctgtgaagtacatcgactacgataccagctttggtgaagaggagaaaaaacaggccaaggtgttgaaggttgcttgcaatcttaacgatgcagcttgcaagctgaagctgaaagattataaacaggctgaaaaattgtgcaccaaggtgttggaacttgagggtagaaatgtgaaggctctgtaccgaagggctcaggcatatattcagctggcagatttggatttggctgagcttgacatcaagaaagctcttgaaatagaccctaacaacagggatgtgaagctggagtacaagacactgaaggagaagatgaaagaatacaataaaaaagaggccaagttctacggcaacatgtttgccaaattgactaagtcggactctcccgatagcaataaagaagctgctaaagatgccgaacccatgagcgtagacagcaaggcataaagggattgcatcgcataatcggctctcgacttcatattgtgtcattaaggagtaaatccctagttttttgagctgtaggactactcggtattggcacaaagttgtaattgacttgctttcttcacctggattgtgaacatgggattttattggtaattttcaggagtattaagggcattctccccc

SEQ ID NO: 399 - DNA, 1336 bp, Malus x domestica
actcagcgtcccttcaaaagcttgacctatcagcgccacccacgtgtagtacaatcaacgtgccggcaccggcttcccttccatagctccaccaggaaaaaccacctcaccgcgtcaaaaataccttctctctctctctctctctctctcctctttctctccctccctccccaaaaatctcctggtgcgtagctgcccttttcgccccaattctcaattcgcatcgaggtccttgaagatccctgtacccaaacaccaactttccttctacgtcctcgaaattcgcgtcgggattttctcgggaaagtaagggctagggtttgggagggaaacaacaagatgagctttcgggatctggaagcgggtcggggctccaattattcccggcgaggagacctcggcactggaaagcaggatcccacccaagctgtggcctccggcattttccagatcaacaccgccgtatccaccttccagaggctcgtcaacaccatcggcacccccaaagacacgccggatctccgcgaaaagctgcacaagacragactacatatygggcaattggtgaaggatacttcagaaaaacttaaacaagtcagcgaaagagatcatcatactgaagttaatgcaagcaagaagattacagatgctaagcttgcaaaagattttcaagcagtgctgaaagaatttcagaaggctcaacgacttgcagctgagagggaaacarcatatgctccttttgttcctcaagcagttcttccgacaagttacaccgctagcgagatagatgtaaactcagacaaaagtctggaacagcgtgctctccttgtggaatctagaagacaagaggttgtgctattggacaaygagattgcyttcaatgaggctatcatygaggaaagagaacagggaatacaagaaatccagcagcarattggtgaagtgaatgakatttttaaagatcttgctatactggttcatgarcaaggaacmatgattgatgacattggctccaatattgagggtgctcatgctgcaactgggcaggcgaagtcccaacttgtgaaggcatcaaagacccaaagatcaaattcgtctctgacttgcttgctcttggtaatatttggaattgtgcttctcatcgtgatagtagtacttgcagcttaaycaraagattgtctaaactcaatgacagcraactaaagattgtgatacgcatccctctgctatttctgcgatgcctgactagagtttgccgttgtattctatgttcgtatataggggtgggtatcctttgcaatttctggttgcggttgggtgaggtgtctgttctgtt

SEQ ID NO: 400 - DNA, 1577 bp, Malus x domestica
gaaaaagaaaacgaaaggaacacaaaatcgaactgtggagattggagtttatatgaccgggagaaattgctgaagtgcacaagaactagtttctcttcttaattatcagattctgcgatctgggttttgagaagaaaaaaaccatattttctcaggaaaatccgtaaaagttttccttttcttcttcgtacatttgtaatattgggttcgataaactaacgtcatctgagttttatgttgttgggttgtgaatcttttgatctgggtccctctgtttcggcttcataaattggagactgagtgtttcagtgtgtaaaaaaaatgaaggaaaagcttggatttttagtgtgtgtgtggtttctgctatgtagggtttgtgtggggaggttcgtggtggagaagaacaggttgaaagtgacttctccgagctcgatgaagggcgattacgaatgtgcgattgggaactttggggttcctccatacggaggaacgttggtcggaactgtgtactatccgaagaccaatcagatggcatgcaaagggtttgaagataccgacgaaaccttcaaaccgaagccccgtggtctgccgacgtttgttcttgtcgatcgaggagattgttacttcacaacgaaggcatggaatgcacagaaagcgggagcggccgccattcttgttgcagatgacaggaatgaaccgttgattaccatggacactcctgaagaagaaaatgcggatgctgctgattatctgcagaatatcacaattccttcggctctcattagcaaagagttgggagatagtataaaaaaatctctatcgggtgatgagatggtcaacataaatctagactggacagaggctcttccacatccagatgaacgtgttgagtacgagttttggacgaatagcaatgatgtgtgcgggccaaagtgcgacagccagattgagtttgtgaagaactttaaaggagcagctcaggtacttgagcggaaggggtacacccaatttactccacactatataacatggtactgtccagaagcttttgtttcgagcaaacagtgcgagtctcagtgtatcaatcatgggaggtactgtgctcctgatccagagcaagatttcagtgaaggttatgatgggaaagatgttgtggtccaaaatctccgtcaagcttgcttctataaagtggccaatgaaagtggaaagccatggctttggtgggactatgtcactgactttgcgatacgttgcccaatgaaagagaagaagtacaaccaagaatgtgcaaatcaagttattgaatcccttggtgctgatctgaagaagatacaggaatgtattggcgaccctgaagctgatgaggagaatgcagttctgaaggccgaacaggatgcccagattggcaagggctcccgtggagatgttacaatattgccaactcttgttataaaccgcgtacagtacagagggaaactggacaaaggagctgttctcaaagccatctgttctggtttcctagagaacactgagcccgctgtctgtttaagtgaagatgtgcaaacaaatgagtgttt

SEQ ID NO: 401 - DNA, 911 bp, Prunus armeniaca
ggcacgagctatactggaattctaggcatgcctggaatgactgcttatgctggtttttatgaggtttgctctcctaagaagggagagacagtttatgtttcagcagcatctggagcagtaggtcagcttgttggccaatttgcaaagttgtctggttgctatgttgttggtagtgctggaaccaaagaaaaggttgatctgctgaagaaaaagtttgggtttgacggcgctttcaattataaagaagaacctgatttggatgcagcattaaaaaggttctttccggagggcatcgatatatactttgaaaatgttgggggaaagatgcttgatgcagtgctgccgaacatgagggtccacggtcggattgcagtttgtgggatgatctcacagtacaacctggagcagccggaaggggtacataatttaatgcatctggtcattaaacaggtccgcatggaaggtttcctggtttttaattactatcatctttacgggaagtttcttgaaatggttttgcctgccataaaagaagggaagataacgtacgtggaagatgtagttgaagggcttgagagcgctccagcagctctgattgggctctttgcggggcgcaatgtaggaaagcaggtcgttctagtttcccgagaatgacttgatcagactcgacactctcctccatgcctctctccctctctctctctctctctctctcaagtctgaactgaagctttctttctttctttggcttagcctagcctatatggtagaatcatcatctactgtaaatgcaaatgcaagcaaatgcttcttctccatttacaactttatacttgttctacttgtacaaggtttgtggcgaagcttgtttaataaatgttgttgaacttttttgatctttcaaaaaaaaa

SEQ ID NO: 402 - DNA, 1315 bp, Prunus armeniaca
ggcacgagctctctctctctctctcttccctttacccttcctctccctctctctctctctcttccgaatcatcgcctcctgcttatctccccgttcttcccgcaattcttaattcgtatccaaacaccagcttctctttccattttttcgaaactcttgtcaggattttctcgggaaagtaagggttagggtttgggagggaagcgagatgagctttcgggatctggaagcaggaaggggctcgggtttttcaaggcgtgacatcgtcaatggcaagcaggacccgacccaagccgtggcctcaggcattttccagatcaacaccgccgtatccacctttcagaggctcgtcaacaccatcggtacccccaaggacacgcccgagctccgcgaaaagctgcacaagacaagactacatattggtcaattggtgaaggatacttcagaaaaacttaaacaagttagtgaaagagatcatcatactgaagtcaatgcgagcaagaagattacagatgctaaacttgcaaaagattttcaagcagtgctgagagaatttcagaaggctcaacggcttgcagctgagagagaaacagcgtacgctccttttgttccccaagcagttcttccgtccagctacactgctagtgagatagatataagctcagataagagtcccgaacagcgtgctcttcttgtggaatctagaagacaggaggtcgtgctattggacaatgagatttccttcaatgaggctatcatcgaggaaagagaacaaggaatacaagaaatccagcagcaaattggtgaagtgaatgagatttttaaagatcttgctatattggttcatgagcaaggaaccatgattgatgatataggctccaatattgagggtgcccatgctgctactggccaggcaaagtcccaacttgttaaggcctcaaagacccaaagatcaaattcatctctgacttgcttgctcttggtaatatttggaatcgtgcttctcattgtgatagtagtacttgccgcttaatcattggaaaaagtcaagatgtgctctcaggatcccctatgataatttctctaatgggttgtctcttgggatatcatgtctaactcaagtttttcgctgtattataagttggtatatataggaggtgggtagccttaacaattatctggttgttttggttggttttggttatgtgggatgtgtttttttccttattctgtaagttggtgtttggggcttcagatggtgttctttatctaataatataaatattgataaatttcataattctttgggttttca

SEQ ID NO: 403 - DNA, 2134 bp, Aquilegia formosa
tcaatatggtggaacaatggttggaactgttgtttatcctaaagctaatcaaaaggcatgtaaggctttcgatgatgatgcgtcggttaaatctaaacctggtgctcttcccacttttattcttgctgatcgaggagattgctattttacgttgaaggcatggaatgcacaaaatgctggggcagctgcaatactagttgcggatgataagattgaacctttgattacaatggacacacctgaagaagataattcacatgctgattatctacagaatattactatacctgcggcgcttattagcaaagcttttggggacagtattaagaaagctctagcaaatggagacatggttaatattaatttggattggagggagtcacttcctcatcctgatgagagggttgagtatgagttctggaccaatagcaatgatgagtgtggaccaaagtgtgaaagccagattgatttcgttaagaacttcaaaggagctgctcagatacttgaacagaaaggttatactcagttcactccacattacatcacttggtactgccctgaagcctttatcttgagcaagcagtgcaagtctcagtgcatcaatcatgggagatattgtgctccagatcccgagcaggattttagtcgaggttatgatggcaaggatgttgtggtgcagaatttacgccaggcttgcttgtataaagttgctaatgaaagtggcaaatcgtggctttggtgggactatgtaactgactttgccatccgttgtccaatgaaggagaagaagtacactaaggagtgtgcagatgaagtcatcaagtctttgggtcttgacctcaagaagatagatcaatgtataggagatcctgaagctgatgtggagaatccggtgcttaaagcagaacaggatgctcagattggtaaaggatcccgaggtgatgtgaccatattgcctactcttgtaattaacaacagacaatatagaggtaagttggacaaaggagcagtgttgaaagccatatgtgcaggttttcaagaaacgaccgagccagcagtttgtttaagtgatgggattgaaaccaatgagtgcttggagaaccatggaggatgctggcatgatgaggtcgctaacattagtgcatgcaaggatacttttcgagggagagtgtgcgagtgccctgttgtccaaggtgtaaagtttgttggcgatggttatacccattgtgaagcttcaggagctctacgttgtgaaataaacaatgggggttgttggaagaagacccaagatggacggacttactctgcatgtgtagataacaattctaaaggctgtaagtgccccccaggatttaagggcgatggagttaacaagtgtgaagatgtggatgaatgtaaggagaggcttgcatgtcagtgttctgaatgcagatgcaagaatacgtggggaagttatgaatgcagctgcagtggtaattcgctgtacatgcacgagcacgacacatgcatcggtcaagagagcaacactcggtttagtgggagctttgtgttggtcattttcctcggcttggctgctgcaggtgttgcgggttatgctgtgtacaaatacagaatccggagatatatggactctgaaatccgagctatcatggcacaatacatgccgttggataaccaggcagaggtgccaaatcatgtgtcccatggggacatctgaaagctcgatcatcagtgaaaagattggctgaccaagaccaaatatgtgcataccgaagtttcttctcccattaagtaggtcagaggttggcttttcttcccataaggtcaggggtattgtatcgctggtgatggtgctgctgctgctgctgcgttctctgtgattcgaaggtcttgatctggctcttatgtacgtgtatgtatgtgtttatcccatgtatatttgaacctaatacacggatctcaccacatgagagggtaggaacttttttgttcgtttttctatcttgtctctcacggtacaagtttatgtgtgggatgtattttgatgatatttttctgctcatcaactagccctgtttcccacagaacgaggagtgttttacctcctttgcatgaaaatgttatatgaaatgtc

SEQ ID NO: 404 - DNA, 1404 bp, Aquilegia formosa
cctgttgtttgttgaatgttaacttgtgtcgttctggcttttccctctattttctccgccaattcagttaaatttctctctcaaaaaccctaattgtaattaaatttccaggcaattaattattgaaaatctctctctttatatccttctatttgccctagaaaccaaccgttctcacaattgtgtgagatcggtgtgtgtgtttagaggttcaattgaattattggaattgaaattgaatttttttaattagggttcgagaagatgagttttcaagatcttgaatctggtagaccaattgcatcaagaagagaatacatcaatggtaaacaagatccaacacaagctgtggcttctggtgtttttcaaatcaatactgctgtttcttcttttcaacgtcttgtaaatactcttggtacccctaaagatacacctgaacttcgtgacaaattgcacaagacaaggctacatattgggaatttggttaaggatacctcagccaaacttaaacaagccagtgaagcagatctttacactgaagttagcgcaagcaagaagattgcggatgctaagcttgcaaaagatttccaggcggttttaaaagagtttcagaaggctcaacgtcttgcagccgaaagggaaacagcatattcccctgttgagaagaaagttccatccagctatactgcaagtgaattagacataaattcagataggaaccctgaacagcggtctgctcttgtggaatctagaagacaagaggttctgctactggacaatgagattgtttttaatgaggccattattgaggaaagggagcaagggatccaagagatccaacaacagattggtgaagtaaacgacatttttaaagatttagccgtgctggtccacgagcaaggagttatgattgatgatattgactccaacatcgagagctcacacgccgcaactgcacaagcaaagtcccaacttgtgaaagcatccaaaacccagaaatcgaattcgtcactgacgtgcttgctcttggtgatatttggggtagtgctcatcatcgtgatgatagtcctgatggcttaatattagcaaatcttgtctgtatctgatgattgagcaaggctgatatcttttcagcaacaaggttgctcgctttattgggtttgttgttggctgtgttgtttacttttataccatccgagtcattgactcagtttctctctcatcgggttggaagtaatatctaagtggtcagtcttgttatgtataaccttcagttgcttctgttttgggtgtgactccttttctcttgtaagtggttgtttgagtttcaggggtgtgtttgtgtccatgtgtttgaatatctctataaattgatccttttgttaataataaattcgtattttt

SEQ ID NO: 405 - DNA, 1038 bp, Aquilegia formosa
gaccagaagcaatgaatgaagatatggattttggcgatgaaactccaatgtttaaagttggtgaagaaaaggagatcgggaaacaaggtttgaagaagaaacttattaaagaaggtgaacgttttgatactccagataatggcgatgaagttgaagttcattatactggaactttgcttgatgggactaagtttgattcaagccgtgaccgtggtactccattcaaattcaagcttggacaagggcaagtgatcaaagggtgggatcagggtatcaagacaatgaagaagggtgaaaatgcactatttacaatcccccctgagttggcatatggtgaatccggctctcctccaactattcctcctaatgccacacttcaatttgatgttgaacttctttcatggtctagcgtcaaggacatatgcaaggatgggggaatattcaaaaaaatagtcacagaaggagagaaatgggagaatcccaaagaccttgatgaagtgtttgttaaatatgaagctcgtctagaggatggcactttagtttcaaaatctgaaggggcagagttcactgtcaaagatgatcatttctgtcctgcactgtcaaaagcagtgaagacaatgaaaaagggagaaaaagtaatcctaacagtgaagccacaatatggatttggggagatgggaagaccagcctctggtgctgaaggtgctgtcccaccaaatgccacgcttcttataacccttgagctagtttcgtggaaaactgtaacagaggtaactgatgacaagaaggttataaaaaagatccttaaagaaggagagggctatgagcgcccaaatgatgggacagttgccaaagttaaattgattggaaagctgcaagatggaactgtattttttaagaaggggcatgatgacgaactctttgagttcaagacagatgaagagcaagttataactggacttgatagagccgtgatgactatgaagaaaggggaggttgcactattaacaattgatcctgagtatgcttttggttcat

SEQ ID NO: 406 - DNA, 1123 bp, Aquilegia formosa
cagacgggcgatgggcgagacggacgatgagctgctcaagaacttcttcgctgaagtcagcgaagttgaaagagaaaatgaagttcaaaggattctttcatgtttcaagctaaatgcttttgagtatctcaaccttccatttgattcatcgcctgaagatgtgaaaaggcagtaccgaaagttatctttgctggttcaccctgataaatgcaagcatccacaagcaaaggaagcatttggagcattggcaaaagcccagcagttactgcttgaacctcaggagagggaatatctacttagtcaagttaacgcagcgaaagaagaactccgatcaaagaggaaaaagttgttaaagaaagacaatgcttctaagttaaagtcacaggttgacgagggaaagtatgagcaacagtatgagaaatcagatgagtaccagcaacaactgaagatgaaggtgcgtgaactattaacagaacacgaatggcgccggaggaaaatgcagatgaggatttcagaagaagaaggaaggttgaaaaaggatgaagaagaaacgaaagaaatgtggaaaaagaagcgtgagcatgaggaacagtgggaagggacaagagaaaaaagggtatccagctggagagacttcatgaaaacaggaaagaaggccaagaaaggggagatacgccccccaaagctcaagactgaggatcctaacaaatcctatgttcaaagaccagtgaaacgagggtgaaagagaggatgttactggttacgattacggctgggctggcaactgtaggttttaaattagctctatcatgtcctgtcttcagtggagaagctcgatagatgcaactagctttgacttcatctgcgcatctttacaatcatgggatatttatcgtcaaggaaaaaagaaagggttctatttattaacgcaaatttgcataacaattcttgtattttctcttaacgtaatcaaaagactcccaggagcttgaattgcctgcataaattgttagtcttggagattctctgaaattctaatttcagatatcttatatcaatgacattgaatgtaaataggcaagagggtttagattctcaatgtaatgttgaggttttatccata

SEQ ID NO: 407 - DNA, 1841 bp, Aquilegia formosa
gaacaagcttgttggtgatttcgattcaattcgctcgctcgctcgctcattcatactatcgtacgtaacgtctttatctatcataaacagaagtaaaagcagcttataaaaaccctaataatatcgaattggcaaattccgtgtttttcgaattcaaagacatttcgattcaatattcaacatctgatatacaaacattgactgcaatcattcatcatggcaagaaagatgcttatcgatgcagaagtgagtaactctgttgaagaagaacagtatgatttcgatctgtttgtcatcggagctggtagtggtggtgttcgtgcttctagaacttctgctgcactaggagctaaggttgcgatttgtgagcttccatttcacccgattagctcagaagttattggaggagttggtggaacttgtgtgatccggggatgtgttccaaaaaaaatattggtttatggagcatcttttgcaggggaatttgaggatgcaagaaactttggctgggaactgaatgaaaaaatagacttcaattggaaaaagttattgcataacaagacacaggaaatactcagattgaatgggatatacaagcgaatgttgtccaattctggggttaaaatgtttgaaggcgaagggaaggtagttggcccacatgaagttgagctaacacaattagatggcacaaaactatccttttctacaaagcacatattgattgcaactgggagtagggctcagcgtgtacccattcctgggcaggagttggcaatcacatctgacgaggcattgagcttggaagaattgccaaaacgggctgtggtactgggaggagggtacatagctgttgaattcgcttcaatatggcgtggtatgggtgctaccgtggaccttttctaccggaaagaacttccattaaggggttttgatgatgaaatgagaaatactgttgcaagaaatctggaagggaggggaattaagctgcaccctggggcaactttgaaggagttgatcaaaacagatgaaggtataagagtaattacagataatggccaagaactgatggctgatgttgtactttttgccacgggccgaacacctaatacaaagagagtgaatctgcaagctgctggtgtggagctagatagaagtggagctgtgaaggtagatgagttctctcagaccaatattccgagcatatgggctgttggtgatgttacaaacagaataaatctaactcctgtggccttgatggaggggtcctgtttctcaaaaactgtctttggtggccaacctactaaaccagactaccgtgatgtaccatgtgcagtgttctgcatcccacctctttctgttgtgggcctcagtgaagaacaagctgtggagggagcaaagggtgacatagtgatatttacatcaacattcaatccaatgaagaacaccatctcaggacgacaagagaaaacaatgatgaaacttatcgttgatggagagacagataaagttcttggcgcatctatgtgtgggccagatgcagcggaaattatgcaggggattgctattgcaatgaaatgtggtgccaccaaggcacagtttgatagcacggtgggtattcatccatctgcagcagaagagtttgtcacgatgcgaacagagactagacgaattgctgctggtagtaagcctaagacaaatctgtgaagcatttgagaaaagggggttttcttagttgggggattgttctagaattgtatttgtcattagcacatgagaataaattgcttaaagaaaaatcagttgtaaactaagacaattgacctgttgatatcacaagtata

SEQ ID NO: 408 - DNA, 2540 bp, Arabidopsis thaliana
aagttttccaaaattgttgactctcttttacaactacacaaaaacctttcttcaaaatattctcagattctcttcttcttccttcgagctttcacagttgattcaattcccgatttcaaactcaatcaccttcagattccgatctccattctctacatcaatcacaatggagaatccgaatccaccagcagagaagctattgaagaagatacgagagctagaagaaagccaagaagatctaaagcgagagatgtcaaaactcaaagtatcagcagagattaaaaggcgttcgcattcttcatcacctaaacgaccttcaaggagaaacagtggagaaggaactccgttatggagaaaaaccggcgccgcatcgttccgtcacgcttctccgttacggaaagagagtcattctaaagacggagtagctggtggtggtgatggaccatcggcaggcaagttcaccgataaacagtatttgaatattttgcagtctatggctcaagctgttcatgtcttcgatcttaatggccaaattatcttttggaactcgatggcggagaagctttatggattctcagctgcagaagcgttagggaaggactcgattaatatactcgtagatggtcaagatgctgctgttgcaaaaaatatctttcagcgttgcagcagtggagagagttggactggagagtttcctgttaagaataaaatgggagagaggttttcggttgtgactacgatttctcctttttatgatgatgatggtttgcttattgggattatatgtatcacgaatgattcggcactttttcaacggccgagagttcctcccgctaaaaacaggtggcaagaaggggattcaagcttttgccgggggactaatggtgttgcttctaggcttggttttgattccaaagaagctgttgtgtcgaaacttggccttgattctcagcagcctattcaagctgctatagcatctaagatctcagatttggcatccaaggtgggcaacaaggtcaggtcgaaaatgcgagcaggtgataataacgcctcacaccctgagggtggaaatgggggcagtcatcagtctgatcagggtttcttcgatgctgctttctctgaccagagggaagatgcagaaacaaatgatgctagcacacctagggggaatttgatccagtctccttttggtgtgttcttatgtaacgatgataagtcttcttcaaaagcctccggagaatccaatgatgaaaatgatagaaactctgttgtccctaagaaacttacctcaaagactgaagagtggatggtaaagaaaggactgtcatggccatggaaaggaaatgagcgggaaggtttggaaagaagaaatgctcattctgtgtggccttgggtgcataatgaacaacaaaaagaagaggctcatcatagtaattcctataacagtgttaagtctgaaagcctggcaagtgaaagtaataaacctgccaataatgagaatatgggttctgttaatgtgaatagcgcaagcagtgctagcagctgtggaagtaccagcagcagtgttatgaacaaggttgacatggatagcgactgcttagactatgaaatcttatgggaggatttgacaattggagaacaaatcgggcaaggttcatgtggaactgtctatcatggtctatggtttggatctgatgtggctgtaaaggtgttttccaaacaagaatattcagaagagatcataacatctttcaaacaagaggtatcattgatgaaaaggcttagacatccaaacgttctgctgtttatgggagctgtggcatcacctcagcgtctttgtatagtgacagagtttctaccacgtggaagtctctttcgtttgctgcagaggaacaagtcaaaactagatttgaggcgacgtatccatatggcatcagacattgctcgtggcatgaattatcttcaccactgtagtcctcccatcattcaccgtgatctgaagtcgtcaaatctactggttgatcggaactggactgtgaaggttgctgattttggtctttctcgcatcaagcatgagacgtacctcactacaaacggaaggggaacgcctcaatggatggcaccagaagttcttcgaaatgaggctgctgatgaaaagtctgacgtttacagttttggagtagtactatgggagcttgtgacagagaagatcccatgggaaaatctaaatgctatgcaggtgattggagccgtggggttcatgaaccagaggctggaagtcccaaaagacgttgaccctcagtggattgctttaatggaaagctgctggcacaggtacataaatcatattaaacattacatataccttgctagaggaaaatagcctcactaatgattcggtacaaaattggttgcatataggagggaccaaaacttggtctcctaaacatctcgtcatatgccatgctctgattttctgctgtagctgaactaaacctgatgttttgtgtcatcaatgaacatagtaaaataaccataaa

SEQ ID NO: 409 - DNA, 2068 bp, Arabidopsis thaliana
tttcttcgctaaccacacaaagcttgttcttctccttccttctccaatttcgtaagctcaaagatttcgatttcgattttgattattgccaaaggtttaaagatggatattttcgacaactctgatcttgaataccttgttgatgaatttcacgctgatttcgatgatgatgagccctttggagaggttgatgtcaccagtgagtctgattccgatttcatggactccgattttgatttcgagctgagtgagagtaagacgaacaatgaaacatcagcgttagaagctaggaatggaaaagatattcaagggattccatgggagagcttgaattacacgagggatagataccgtgagaatagattgctgcactataaaaactttgagagtctgtttcgatccagagaagagcttgataaggaatgcttgcaagtagagaaaggaaagaacttttatgactttcagttcaatacaaggcttgtcaagtccacaatagcgcattttcagctgaggaacttggtatgggcaacatcaaagcacgatgtgtatttcatgaacaactactctctcatgcactggtcatctttgttgcaaaggggcaaagaagtacttaatgtggcaaagcccattgttccttcaatgaagcagcatggatcgttgtcacagtctgtatcaagagtccagataagcaccatggcagttaaagacgatttgaagttgcgggagggttccaaggagagcttatctaaaatcaacgaacctgaggttgctttctgcactaaactaacatcagctgataacgacatcaccaattcggttgacatctacaacgcacctagtggctcgttaagggttatgaccgcgaacaatgactgtactgtccggctatttgatgccacaaactttgccttgctcaacagatttgcctttcactggtctgtaaataacatctccaccagtccagatggtaagctagtggctgttctaggagacagtcctgagtgcttactagcagataccggatctggaaaagtgatccacggactcgaaggccatctcgactactcgttttcatcagcatggcacccaaacggtcaaatcttagccacgggtaaccaagacacaacctgtagactatgggacgtaaggaacctgtctcaatcactcaaagtcttgaaaggaaacatgggagctatcagagccttgaggttcacgtctgatggacggttcttagccatggctgagccagcggactttgtacacttgtttgacacggaagctggttacagtcagtgtcaagagattgatctgtttggagaaatagcgggaatctcgtttagccccgacacggaggcactgttcgtgggagtagctgatcgtacgtacggcagcttgttggagtttaacaggaagcgaaaccactcgtatgttgattccatattctgatctgactccaatcgttagaagcaaattaaggagctatatgtatgtgtgagattatggttgtagtggctgttggagggattaaaagtcgttgtttttgtgactttccctttgtcatgtttatgtggttttaggaattccatgtttggtcaactgtagaacatacgtacttatatgagtgctgttaaactttgaagacacaacttgtaggctatggggacgtgaggaacctgttaaaatttgaagcccaactcgatgttcagaagcagcaccaggcctttatttataataaaaatttgtggcttgaagaatgtgattggggtcgatgtgggacaaaaacaacaactagtttcacgggctttaaatagttgaagcccaattaggtgattaaatgtgctgtgaaacagtactgatggttgggagaagttgagattgaaaggattttagagcagcatctaatactaaaagtagtagacataaagatggttaaggagattttgatagtcgagatttctatctttttctcaagacgaataaagcaattaaggaagtgtcatgtactcatgtgtgagtgagccacttaatgtaatgttaaagctttacgaaacattcctcaattacacct

SEQ ID NO: 410 - DNA, 1401 bp, Arabidopsis thaliana
aaacattattgtcaaaaataagaaagaaagaaaaaaatatgggtatccaagaaactgacccgttaacgcaattgagtttaccaccgggtttccgattttacccgaccgatgaagagcttatggttcaatatctctgtagaaaagcagctggttacgatttctctcttcagctcatcgccgaaatagatctttacaaattcgatccatgggttttaccaaataaagcattatttggagaaaaagaatggtatttttttagtcctagggatagaaaatatccaaacgggtcaagacctaaccgggttgccggatcgggttattggaaagctacgggtacggataaaataatctcgacggaaggacaaagagttggtattaaaaaagctttggtgttttacatcggaaaagctcctaaaggtactaaaaccaattggatcatgcatgagtatcgtctcattgaaccttctcgtagaaacggaagcactaaggtaacaaataaaatctaaacattaataaatactatatcttatattttcttcttgtagtgttttgaatgacctataattaatattcttgttaattttctttagttggatgattgggttctatgtcgaatatacaagaagcaatcaagtgcacaaaaacaagtttacgataatggaatcgcgaatgctagagaattcagcaacaacggtacttcgtccacgacgtcgtcttcttctcactttgaagacgttcttgattcgtttcatcaagagatcgacaacagaaatttccagttttctaacccaaaccgcatctcgtcgctcagaccggacttaaccgaacagaaaaccgggttccacggtcttgcggatacttctaacttcgattgggctagttttgccggtaatgttgagcataataactcggtaccggaactcggaatgagtcatgttgttcctaatctcgagtacaactgtggctacctgaagacggaggaggaagtcgagagcagtcacgggtttaataactcgggcgagttagctcaaaagggttatggtgttgactcgtttgggtattcggggcaagttggtgggtttgggtttatgtgatgatgaaatgctgacgcaataaaaataagtcgttaatttttgtcccgtggcaaatcttatatgtatttgaatttcaattcttttgggttaagagggagactcatagatttagatgtagatttgtaatctttcatgcatagaaaatttgacgaatagatttcgtaactttattttgttgctgtttggttatctttgtattggtataaatttagtggattgaaattgcatattgatatattgtttagttgtggctagctatacatgtaagtttaattgtttgagctatccaaaagaatatatttaacta

SEQ ID NO: 411 - DNA, 3227 bp, Arabidopsis thaliana
gaaaagaaaagaaacgtacaaggagaaaaaaggtttccattattgttgactgcttgagaaaaaaaggttaaacgtttctctcgcgtcatttcaattccattttctctacttttgttcttctgttagggagcgagagattagatagtcaaaatcaaatcgacatggattaagcacttagcagcttcttcaaggtccgattcatctcgaaacggtccccgattctactcgatcggaggagtagttgttgttgtggtagggtttacccattttggagcgcaatggagaatccacctgcggaggagctgctgaagaagatacttgagctagaggagagtcaggagcatctcaagcaggagatgtctaggcttaaggtatctacggagcttagacagcgatcgcattcggtgtctcctcatcgtccggcgaggagaaacatcggagagggagctccgtcttggaggaaaagcggtgccgcctcgtttcgtaacgcgtcgccgttgcggaaggagagccgtatccagaattcgatgagattgaggtctgaagttggtggcgggggaccatctgctgggaaattcactgataaacagtatttgaatattttgcagtcgatggcacaagctgttcatgccttcgatcttaatatgcggattatcttttggaatgctatggcggaaaaggtttatgggtactctgcagcagaagcacttggggagaaccctattaatgttattgcagatgatcgggacgctgcctttgcaatgaatattgctcgacgttgtgtccgtggagagagctggactggtgagtttcctgttaagagcaaatcaggggatagattttcagctgtcactacctgttcccctttctatgatgatgatggtgctcttatggggatcatttgtatcaccagtaacacggcaccgtatctgaacccaagaatctctttggctaaattgaaggcgcaagaagaaggtgaaacgagctctatccctgcaaggaatagttttgcctctaaacttggcttggattccagaggagctgttatatcgaaacttggccttgactctgatcagcctatacaagttgctatagcatcaaagatctcagatttggcatccaaggtcagcaacaaggtcaggtcgaaaatgcgagcaggtgataatagtgccacactctcggagggtggcagtggggatagtcatcaaaaagatcataatgtcttcggtgctactcttgttgaccacagggacgatgcagcatcaagtggtgccagcacaccaagaggggattttatccagtctccttttggtgtattcacatgtaatgatgagaagtttgtttcgaaacccttcaaagattccagtgatgagagtgatggaaagcctgcaatccataaggttctcacctcaaaagctgaagagtggatggtaaagaaaggtttgtcatggccatggaaagggaatgagcaggaaggttcaaaaggaagacctacaaattctgtttggccttgggtacagaatgaacaaaagaaagagaggtgtcaccagattaatccctctgctggtgttcagtatgaaagccatgcctttgaaagtaataagcctatcaataatgaggcttctagtttgtggtcttcccctataaatgcaaacagtacaagcagcgctagtagctgcggaagtaccagcagcagtgttatgaacaaggttgatactgatagcgaaggcttggaatatgaaattttatgggatgatttgacaattggagaacaagtcggacaaggttcatgtggaactgtttatcacggtctctggtttggatctgatgtagctgtaaaagtgttctccaaacaagaatattcagcagaggtcatagaatcttttaaacaagaggtattgttgatgaaaagacttagacaccctaacgtcctgctgtttatgggagctgtgacttcaccccagcgtctctgtatagtgtcagagttccttccacgtggaagtctcttccgtctactacagaagagcacgtcaaaactggattggaggcggcgtatccatatggccttggacattgctcgcggtatgaattatcttcaccattgtagtccacccattatccatcgtgatctgaagtcatcaaatctgctggtagacaagaactggaccgttaaggtagctgactttggtctctcgcgtatcaagcatgaaacatacctaaccagcaagtctgggaagggaacgcctcaatggatggcaccagaagttcttcgaaatgagtctgctgatgagaaatctgacatttacagctttggagtagtattatgggagcttgccaccgagaagatcccatgggaaactctcaactctatgcaggtgattggagctgtggggttcatggaccagaggctggaaatcccaaaagacattgatcctcgttggatctcattaatggagagctgttggcacagtgatacaaagctgagacccacattccaagaactgatggataaattaagagacctgcaaagaaagtatatgatacagttccaagcgactcgtgctgcgttatctgacaattctcttctcaaggacaactaattaaaataaaagttgagcctttttacctttttgttcctcaatgccatgcttcaagactcaaagacgttcatgagaacagagaaagatagagaatgggtctgtttgagcagtagtaccagtgggttgatgtgtaattacagcgtggaggagacctataagcagagactgccactgaaattatgggagttgtgttgtgatgtatttgggtcattacacaaactaccaaaagaaacgtattgctcaggttagttactgtaattctggtggtcggttctggtctctatttctctggtggaagcttaaagaaagtgcgtgaaagggatttgatgtgaagttgcaaagttgggtaggttgggcaagagattggattgcatatattattcttactaaacatttatgcgatcaagtgtggtagaaccatttgatgatattttgtacagaggaaaaaaaagggagtttggaactctagttctgagagaatattgtaacaccaattttttttggaacagacatttattgggggatttatgtaatctatacctacgttgaaaggttgtcaaattagaagttatcactaacctacaggttgatcaacaaacttcttgtttcaatgaataccttcgtttg

SEQ ID NO: 412 - DNA, 2842 bp, Arabidopsis thaliana
aagttttccaaaattgttgactctcttttacaactacacaaaaacctttcttcaaaatattctcagattctcttcttcttccttcgagctttcacagttgattcaattcccgatttcaaactcaatcaccttcagattccgatctccattctctacatcaatcacaatggagaatccgaatccaccagcagagaagctattgaagaagatacgagagctagaagaaagccaagaagatctaaagcgagagatgtcaaaactcaaagtatcagcagagattaaaaggcgttcgcattcttcatcacctaaacgaccttcaaggagaaacagtggagaaggaactccgttatggagaaaaaccggcgccgcatcgttccgtcacgcttctccgttacggaaagagagtcattctaaagacggagtagctggtggtggtgatggaccatcggcaggcaagttcaccgataaacagtatttgaatattttgcagtctatggctcaagctgttcatgtcttcgatcttaatggccaaattatcttttggaactcgatggcggagaagctttatggattctcagctgcagaagcgttagggaaggactcgattaatatactcgtagatggtcaagatgctgctgttgcaaaaaatatctttcagcgttgcagcagtggagagagttggactggagagtttcctgttaagaataaaatgggagagaggttttcggttgtgactacgatttctcctttttatgatgatgatggtttgcttattgggattatatgtatcacgaatgattcggcactttttcaacggccgagagttcctcccgctaaaaacaggtggcaagaaggggattcaagcttttgccgggggactaatggtgttgcttctaggcttggttttgattccaaagaagctgttgtgtcgaaacttggccttgattctcagcagcctattcaagctgctatagcatctaagatctcagatttggcatccaaggtgggcaacaaggtcaggtcgaaaatgcgagcaggtgataataacgcctcacaccctgagggtggaaatgggggcagtcatcagtctgatcagggtttcttcgatgctgctttctctgaccagagggaagatgcagaaacaaatgatgctagcacacctagggggaatttgatccagtctccttttggtgtgttcttatgtaacgatgataagtcttcttcaaaagcctccggagaatccaatgatgaaaatgatagaaactctgttgtccctaagaaacttacctcaaagactgaagagtggatggtaaagaaaggactgtcatggccatggaaaggaaatgagcgggaaggtttggaaagaagaaatgctcattctgtgtggccttgggtgcataatgaacaacaaaaagaagaggctcatcatagtaattcctataacagtgttaagtctgaaagcctggcaagtgaaagtaataaacctgccaataatgagaatatgggttctgttaatgtgaatagcgcaagcagtgctagcagctgtggaagtaccagcagcagtgttatgaacaaggttgacatggatagcgactgcttagactatgaaatcttatgggaggatttgacaattggagaacaaatcgggcaaggttcatgtggaactgtctatcatggtctatggtttggatctgatgtggctgtaaaggtgttttccaaacaagaatattcagaagagatcataacatctttcaaacaagaggtatcattgatgaaaaggcttagacatccaaacgttctgctgtttatgggagctgtggcatcacctcagcgtctttgtatagtgacagagtttctaccacgtggaagtctctttcgtttgctgcagaggaacaagtcaaaactagatttgaggcgacgtatccatatggcatcagacattgctcgtggcatgaattatcttcaccactgtagtcctcccatcattcaccgtgatctgaagtcgtcaaatctactggttgatcggaactggactgtgaaggttgctgattttggtctttctcgcatcaagcatgagacgtacctcactacaaacggaaggggaacgcctcaatggatggcaccagaagttcttcgaaatgaggctgctgatgaaaagtctgacgtttacagttttggagtagtactatgggagcttgtgacagagaagatcccatgggaaaatctaaatgctatgcaggtgattggagccgtggggttcatgaaccagaggctggaagtcccaaaagacgttgaccctcagtggattgctttaatggaaagctgctggcacagcgaaccgcaatgtagaccatcgttccaagaattgatggacaaattaagagagcttcaaagaaagtatactatacagttccaagcagctcgtgctgcatcgatagacaactcttctctcaaggaaaaataaacccaacgagcagagaatctgaatatgcatttcgcgatcaacacaacaaaagaagaaagctcaatgaagaaatgcaataaagaaaagcagctaaagcagactttgatatgctctctcattgcgtgagagaggcattctttatatggagttcaattcgaaatcgtcatgtgatgcgatgcgagctacagaggttatacatatgtaattgttgtgccaatctatttatgtaattcttaacagagagagagagagagacagacccagtttttaagaatagtctgtacatgtaacaaacgagtaaaaaccaagatttgtaaccctgatttttagtaaatattgtcacatttatttggatcatacattgttattgttcgtgag

SEQ ID NO: 413 - DNA, 1479 bp, Arabidopsis thaliana
atggccgtttcatcgtcgcatcatgcggttctcttcccttacatgtcaaaaggccacacgattcctctcctccaattcgcccgtctcctcctccgtcaccgccgtatcgtctccgtagacgacgaagaaccaaccatttccgtcaccgtcttcaccaccccaaaaaaccaaccattcgtctcaaacttcctctctgacgtcgcatcatctatcaaagtaatctccctccctttccctgaaaacatcgccggaatccctcccggcgtcgagagcaccgacatgctcccttccatatcactttacgtgcccttcacgcgcgcaaccaaatctctccagcctttcttcgaagcagaactcaagaatcttgagaaagtttctttcatggtctccgatggattcttatggtggacatcggaatccgccgctaaatttgagatcccgagacttgccttctacggcatgaactcctacgcatcggctatgtgctccgccatttcggtacacgagctctttaccaaaccggaaagtgttaaatctgatactgaaccggttactgtaccggattttccatggatatgtgttaagaagtgtgagttcgatccggttttgaccgaaccggatcaatcggatccagcgttcgagctactcattgaccatcttatgtccaccaagaaaagccgtggagttatagtgaacagcttttacgagctcgagtcaacgttcgttgactaccggctccgtgataacgatgaaccaaaaccgtggtgtgttgggcctttgtgtttggtaaatcctccaaaaccggagagtgataaaccggattggattcattggttggaccggaaactagaggaaagatgtccggttatgtatgtggcgtttggaacgcaggctgagatatcgaacgagcagctcaaggaaatagcattagggttggaagattccaaggtcaatttcttgtgggtcacgagaaaggacttggaagaagtaactggaggattagggttcgaaaagagagtgaaagagcatgggatgattgtgagagattgggtagaccaatgggagatattgtcacataaaagtgtcaaagggtttttgagtcattgtggatggaactcggcgcaagagagtatttgcgctggggttccactactcgcttggccaatgatggcagagcagccactcaatgcgaagttggtagtggaggagctaaagatcggagtaagaatcgaaacagaagatgtaagtgtgaaaggattcgtgacaagagaagaacttagtcgaaaggttaaacaattgatggagggagagatggggaagacaacgatgaagaatgtaaaagagtatgcgaaaatggcgaaaaaagctatggctcaagggactggttcgtcttggaagagtttggattcgcttctggaagagctttgtaagagtagagagccagacggtgttaataagttgtcaagttctgatgcttag

SEQ ID NO: 414 - DNA, 2907 bp, Arabidopsis thaliana
aaagataagcaaattagttttccttctttgttgactctctccagattctgtttcttcttccttaatccatctctcaagcttctccaccattttcaccttgattcagcttctccgattcaaactcagatttgatctccgttgatttgatttgactgcgtttttctggcaatggagaagacgactccaccagcggaggagcttctaaagaagatacgagagttagaagaaagccaagagcatctaaaacgagagatgtcgagacttaaagtatcggcggagatgaagcagcgttcgcattcagcatcgccgcaacgtcctgtgaggagaaacagtaacgacggaactccgatgtggagaaaaaccggtgcggcttcgtttcgtcacgcttctccgttgcgtaaggagagccatgcgaaagttgccggcggcggaggcgaggggcaatcggcaggcaagttcaccgataaacagtatttgaatattttgcagtctatggctcaagctgttcatgtcttcgatctaaatggccaaattatcttttggaactcaatggcggagaagctttatggattctcagcttcagaagcactggggaaggatccgattgatattcttgtagatgttcaggatgcttcggttgcacagaatatcactcggcgttgcagtagtggagagagttggactggtgagtttcctgtaaagaacaaagctggagagaggttttcagttgtgactacgatgtctccttcttatgatgatgatggttgtcttattgggatcatatgtatcacaaatgattcggcactctttcaagacccgagaggctctccggctaagacaaggagggggcaagaaggtgaaacgagctttagtcgggtgactagtagtgttgcatctaagcttggtcttgactcgaaagaggcggttgtatcaaaacttggccttgattctcagcagcctatacaagttgctatagcttcaaagatatcagatttggttagtctaattaggttgcatattctgatcttttcgtaaactgtcgtatgactagtgtagtcaacatttcaggcatctaaggtgggcaacaaggtcaagtcgaaaatgcgagcaggtgataataacgctgcaaaccttgagggtggaagtggggacagtcatcaatctgatcagggtttctttgatgctgctttcgctgaccggagggaggatgcagcaacaagtggtgctgatacacctaggggggattttatccaatctccttttggtgtattcttacgtagcgatgagaaagcttctacaaagcccttcagagattccagtgatgaaagtgatggaaactctgttgtacctaaaacactgacctcaaaagctgaagagtggatggtaaagaaaggattatcatggccatggaaagggaatgaaagggaaggtttggaaggaaggcgtagtcattctgtgtggccttgggtgcggaatgaacaacaaaaacaacaggcttatcaaagcaattctaatcacagtgttaagtctgaaagccaggcatgtgaaagtattaaggcttccagtaacgagcctatggggtattggtcttcctctgttaatgtgaacagcacaagcagtagtagcagctgtggaagtaccagcagcagtgttatgaacaaggtcgatatggatagtgactgcttggattatgaaatcttatgggaagatttgacaattggagaacaaatcgggcaaggttcatgtggaactgtctatcacggtctatggtttggatccgatgtggctgtaaaggtgttttccaaacaagaatattcagaagagatcataacatcttttagacaagaggtatcgttgatgaaaagacttagacatcctaacgttttactgtttatgggagccgtgacatcacctcagcgtctctgtatagtgacagagttccttccacgtggaagtctcttccgtttgctgcagaggaacacgtcaaaactggattggaggcgacgtatccatatggcctcggatattgctcgtggcatgaattatcttcaccattgtactccaccgatcattcaccgagatttgaagtcatcaaatctactggttgataaaaactggaccgtgaaggttgctgactttggtctttcgcgtatcaagcatgagacgtacctcactacaaagacaggaaggggaacgcctcaatggatggcaccggaagttctccgaaatgaggctgctgatgaaaagtctgacgtttacagctttggagtaatactatgggagctggtgactgagaagatcccgtgggaaagtctaaatgctatgcaggtgattggagctgtagggttcatgaaccagagactggaagtcccgaaaaatgttgatcctcagtggatttctttaatggaaagctgctggcatagtgaaccgcaggacagaccatcgttccaagaaattatggagaaactaagagagcttcaaagaaagtacactatacagtttcaggcggctcgtgctgcatcaatagaaaactctgccctcaaggaaaaataaaccattaaatggaccgagcggagtctgattatgcgttgagaaagctgagctacataagcaaagcagaaaggtgtttcatgtttgcgttgaagcgcaatgacgagaagcaccaaaaagaagggttttggtatatgcaaacatattctctcgagccattcttttgtatggaattgattctgaaaacgtcatcgattgcgaggcgagctaaagaggttatttatgtaaaaccattatgcctgtgacagacccaattttttaagaatagtctgtacaggtgaaagtatgagatagaatcaagatttggaacactgattctgagtaaatattgccatttttattggaacatgccttgtt

SEQ ID NO: 415 - DNA, 2826 bp, Arabidopsis thaliana
aaagataagcaaattagttttccttctttgttgactctctccagattctgtttcttcttccttaatccatctctcaagcttctccaccattttcaccttgattcagcttctccgattcaaactcagatttgatctccgttgatttgatttgactgcgtttttctggcaatggagaagacgactccaccagcggaggagcttctaaagaagatacgagagttagaagaaagccaagagcatctaaaacgagagatgtcgagacttaaagtatcggcggagatgaagcagcgttcgcattcagcatcgccgcaacgtcctgtgaggagaaacagtaacgacggaactccgatgtggagaaaaaccggtgcggcttcgtttcgtcacgcttctccgttgcgtaaggagagccatgcgaaagttgccggcggcggaggcgaggggcaatcggcaggcaagttcaccgataaacagtatttgaatattttgcagtctatggctcaagctgttcatgtcttcgatctaaatggccaaattatcttttggaactcaatggcggagaagctttatggattctcagcttcagaagcactggggaaggatccgattgatattcttgtagatgttcaggatgcttcggttgcacagaatatcactcggcgttgcagtagtggagagagttggactggtgagtttcctgtaaagaacaaagctggagagaggttttcagttgtgactacgatgtctccttcttatgatgatgatggttgtcttattgggatcatatgtatcacaaatgattcggcactctttcaagacccgagaggctctccggctaagacaaggagggggcaagaaggtgaaacgagctttagtcgggtgactagtagtgttgcatctaagcttggtcttgactcgaaagaggcggttgtatcaaaacttggccttgattctcagcagcctatacaagttgctatagcttcaaagatatcagatttggtgggcaacaaggtcaagtcgaaaatgcgagcaggtgataataacgctgcaaaccttgagggtggaagtggggacagtcatcaatctgatcagggtttctttgatgctgctttcgctgaccggagggaggatgcagcaacaagtggtgctgatacacctaggggggattttatccaatctccttttggtgtattcttacgtagcgatgagaaagcttctacaaagcccttcagagattccagtgatgaaagtgatggaaactctgttgtacctaaaacactgacctcaaaagctgaagagtggatggtaaagaaaggattatcatggccatggaaagggaatgaaagggaaggtttggaaggaaggcgtagtcattctgtgtggccttgggtgcggaatgaacaacaaaaacaacaggcttatcaaagcaattctaatcacagtgttaagtctgaaagccaggcatgtgaaagtattaaggcttccagtaacgagcctatggggtattggtcttcctctgttaatgtgaacagcacaagcagtagtagcagctgtggaagtaccagcagcagtgttatgaacaaggtcgatatggatagtgactgcttggattatgaaatcttatgggaagatttgacaattggagaacaaatcgggcaaggttcatgtggaactgtctatcacggtctatggtttggatccgatgtggctgtaaaggtgttttccaaacaagaatattcagaagagatcataacatcttttagacaagaggtatcgttgatgaaaagacttagacatcctaacgttttactgtttatgggagccgtgacatcacctcagcgtctctgtatagtgacagagttccttccacgtggaagtctcttccgtttgctgcagaggaacacgtcaaaactggattggaggcgacgtatccatatggcctcggatattgctcgtggcatgaattatcttcaccattgtactccaccgatcattcaccgagatttgaagtcatcaaatctactggttgataaaaactggaccgtgaaggttgctgactttggtctttcgcgtatcaagcatgagacgtacctcactacaaagacaggaaggggaacgcctcaatggatggcaccggaagttctccgaaatgaggctgctgatgaaaagtctgacgtttacagctttggagtaatactatgggagctggtgactgagaagatcccgtgggaaagtctaaatgctatgcaggtgattggagctgtagggttcatgaaccagagactggaagtcccgaaaaatgttgatcctcagtggatttctttaatggaaagctgctggcatagtgaaccgcaggacagaccatcgttccaagaaattatggagaaactaagagagcttcaaagaaagtacactatacagtttcaggcggctcgtgctgcatcaatagaaaactctgccctcaaggaaaaataaaccattaaatggaccgagcggagtctgattatgcgttgagaaagctgagctacataagcaaagcagaaaggtgtttcatgtttgcgttgaagcgcaatgacgagaagcaccaaaaagaagggttttggtatatgcaaacatattctctcgagccattcttttgtatggaattgattctgaaaacgtcatcgattgcgaggcgagctaaagaggttatttatgtaaaaccattatgcctgtgacagacccaattttttaagaatagtctgtacaggtgaaagtatgagatagaatcaagatttggaacactgattctgagtaaatattgccatttttattggaacatgccttgtt

SEQ ID NO: 416 - DNA, 1957 bp, Arabidopsis thaliana
gtattgatcaatctaaaaaactcaatggtttaattatattaatgactttagcctaaaaaaacttaagtcagtgtaaaacaatatcgatgtgtgattaagaagagatccaatttaacattacccacacaatcatttgattatttcctcctctccgtatctgtgtctctcttctcttgatcttttagtgttcttgctttgtcgcttcaacgcttaagtttggatttgtgtgagtctgcataatcatggcgaggaagatgcttgttgatggtgagattgataaggtggcggctgatgaagccaacgcgacgcactatgattttgatttgtttgtcatcggtgccgggagtggcggtgttcgtgctgctaggttttcggctaatcatggcgctaaggttggtatttgtgagcttccatttcaccctattagctctgaggagattggaggcgttggtggaacctgtgttatccgtggttgtgttcctaaaaagattctcgtctatggagctacttacggtggtgaacttgaggatgctaaaaattatgggtgggaaataaatgagaaagtcgacttcacatggaagaagcttttgcaaaagaagactgatgagatactaagactgaataatatctacaagcggttattggcaaatgctgcggtgaaattgtatgaaggtgaaggaagagtagttggtcccaacgaagtggaggtgagacaaatagatggcacaaaaataagttataccgcaaagcacatattgattgccactggcagtcgggcgcaaaagcctaatattcctggacatgagctggctattacatctgatgaagctttgagcttggaagaatttcccaagcgtgctatagtgcttggaggagggtatattgctgtggagtttgcatcaatatggcgtggaatgggtgctactgtagatttattcttcaggaaggaacttccgctaaggggttttgatgacgaaatgagggcactagttgctagaaatcttgaaggaaggggcgttaatctgcatccacaaacaagtttgactcagttgacaaaaacagaccaggggatcaaagtcatatcgtcccatggggaggaattcgtggcagatgtcgtcctatttgctactggcagaagtcctaataccaaaagattgaatttagaagctgttggtgttgaacttgatcaggctggagctgtgaaggttgacgagtattcacgaactaatatacctagcatatgggctgtaggagatgccacaaaccgaattaaccttacacctgttgcgttaatggaggccacctgttttgcgaacactgcttttggtggaaagcctactaaagcagaatacagcaatgtcgcctgtgctgtattttgcataccaccactagctgtagtgggtctcagcgaagaagaagcagtagaacaagcaaccggtgatattctggtcttcacctcaggctttaatccaatgaagaacaccatttctggacgccaggaaaagacattgatgaagctaatagttgatgagaagagtgataaggttattggagcatccatgtgcggtcctgatgcagctgagatcatgcaggggattgcaattgcgctcaagtgtggagcaaccaaagcacaatttgatagcacggttgggatacatccatcttctgcagaggaatttgtgacaatgcgcagtgtgaccagacgcattgcccacaaacccaaacctaagacaaatctatgaaccgcaaaatataaagagctatatagcatgaaaactcggtacacttaatttgatcaaagagtcagacaacgatgagtttaatcatactcgtgtcccaataaaggatttgtaatttttgtttgtttgtatgatgcttctcttcttacttacttgagaaaacatcaaggtttcttctcttattgcttagtggaactttattacaaagaattattcta

SEQ ID NO: 417 - DNA, 1982 bp, Arabidopsis thaliana
gcagaaagatacagacttaaacgaagatagagatagagagagagacgaagttttgtttttattttttcataaatatttgttttctttttggatatttaaaaaaaaaatgggttcggaagcgaccaccgccgtgaacaaccttcagcaaccgttactggagtcaacaaaatcagaagctgacttcaggatggagagtgtattaacggacacacacttgtcatattttcggcggatctaccttgcgtcgttgatcgagatgaagtaccttttccacttggcggctccggcgatctttgtctacgtcatcaacaatggcatgtctatgctcactcgtatcttcgctggtcgtttgggaagtatgcaactcgctgccgcttctctaggaaacagcggtttcaatatgttcactcttggtctcatgcttggaatgggaagtgcagtggagacattatgtgggcaagcgcatggagctcatagatacgacatgcttggagtctacttacaaagatccacgattgttcttgtcataaccggacttccaatgactttactcttcatcttctcaaaacctctcctcatttccttaggcgagccagctgacgtagcatcagtggcatcagtattcgtctacggtatgatcccaatgatcttcgcttacgccgtcaacttccccatccaaaagtttctccagtcgcaaagcatcgtcacgccgagtgcttatatctcagccgcaacactagtcatccacttaatcctctcttggctctctgtctttaagtttggttggggcttacttggtctctccgttgttcatagtctctcgtggtggatcattgtcctcgctcagattatttacattaagataagtccaagatgtcgccggacttgggatggttttagttggaaagcttttgatggtctttgggactttttccagttatccgcagcttccgccgtcatgctctgccttgaatcttggtactctcagattcttgttctcctcgccggacttcttaaagaccctgaacttgctttggattctctagcaatctgcatgtcaatctctgcaatgtcgttcatggtgtcagttggattcaacgcagctgccagtgtgagagttagtaacgaattaggtgctggaaatccaagatcagcagcattttcaaccgcggtaactacaggagtgtcatttttactgtcattgtttgaagccatcgtgatcctctcgtggcgacatgtcatcagttacatttttacggatagtccagcggttgcggaagccgtcgccgagctctctcctttcttagccattaccatagttctcaatggagttcaacctgttttatctggtgtggccgttggatgtggatggcaagcatatgtagcttacgttaacattggatgttattacattgtggggattccgattggttatgttcttggtttcacctatgatatgggagctaggggaatatggacagggatgattggtggcacactcatgcaaactattatcttggtcattgtcacattccgaaccgattgggataaagaggtggagaaggcttcgagacgattggaccagtgggaggacacatctccgcttcttaagcaataaaataaataaattgatttttttttcaaaaaaaagaaaaaattagcttggggagattcaaagatcaattatataaataatttttggttttccccaaaatgatttttaaatggataaaaccctagttagttattcaagagatatgcgaatctcttgattaatgaattggaaaatcgattgttttctgagggggttagagtgaagagaaggatgccaatgtacatctatttttgtaagagaaaatattgagaagtgagaatgatatattgaaaaaaatgttgtattgtatggaagagtgaatttgttgtaatcgtttcttgtatgaaataaatcagataatgaaaaatgggtgttatggtccacaaaa

SEQ ID NO: 418 - DNA, 2014 bp, Arabidopsis thaliana
caacctcgtataaatctcaccaatccatttcttctcttcttctttgcgttttttgtttggaactgaatcgaaaaagatggatgctaatttcgagatgcctccagtcggtggaatgaacgacgacgacgacatggatttcggtgacggcgcctcgtttcttaaagtcggtgaagagaaagagatccaacaaggtttgaagaagaagcttcttaaagaaggtgaaggatatgaaactcctgagaatggcgatgaagttgaagtgcattacactggaactttgcttgatgggacgaagtttgattcgagtcgtgatagagcaacgcctttcaaattcactcttggacaaggtcaagttattaaaggatgggatattggtattaagacgatgaagaaaggtgaaaacgctgttttcactatacctgcggagctagcatatggggaatctggttccccgccaactattcctgcgaatgctacgcttcagtttgatgtggagttgcttaaatgggacagtgtgaaggatatatgtaaagatggtggtgtgtttaagaagattcttgctgttggagagaagtgggagaatccaaaggaccttgatgaagttcttgttaagtttgaggcgaaacttgaggatggtactgttgttgggaaatctgatggtgtggagttcactgttaaagatggtcatttctgccctgcacttactaaggctgtgaaaactatgaaaaagggtgaaaaggtccttctgacagttaaaccacaatatggttttggggagaagggcaagccagcctctgctggtgaaggcgcggttcctcctaatgcgacgctcgagatcaatttggagttagtttcgtggaaaacagtgtcagaagtaactgatgataacaaggttgtgaagaaagtcttgaaggaaggggatggatatgagcgtcctaacgagggggcagttgtgaaagtgaaattgatagggaaacttcaagatggtactgtatttttgaagaaaggtcatggtgagaatgaggaaccgtttgagttcaaaacagatgaagagcaagttgtcgatggacttgatagagctgtcatgaagatgaaaaagggtgaagtggcattggtgaccatagaccctgagtatgcctttggttctaatgagtcacaacaggaattggctgtggtgccgccaaactcaactgttacttatgaggttgacctattgactttcgacaaggaaagggaatcgtgggacatgaacactgaggagaagattgaagctgctagtaagaagaaggaagaaggaaattccaagtttaaaggaggcaaatattccctggcttccaagagatatgagaaggctgtcaaattcattgaatacgacacatccttcagtgaggaagagaagaagcaagcaaaagcattgaaggtggcatgcaatctaaacgatgcagcctgcaaactcaaattgaaagattacaagcaggccgaaaaactatgcacaaaggtgttagagctagaaagcaccaatgtgaaggccttataccggagagcgcaagcgtacatggagttgtctgatttagacttggccgagtttgatgtcaagaaggcccttgaaatcgatcccaacaacagggaagtgaagctagagcagaaaaggttgaaggagaaaatgaaggaattcaataaaaaggaagccaaattttatggaaacatgtttgcgaaactaagtaaggaataatcaaaagatggagaggcaatgagcacctgaggtcttgaaaacgttgcaagaactctgcatttttcattttctactcttttggtttgttgcaatgttttctagtttttcaacctgagcgttagtgagacactaagacttataaaacagtgagagattatcccaatgtgttgcttttttcgtctgattgttggtagaaacttggagctattgatagcaaaaaaaacctaactttccagattaatttgagttcttaatatgatatcgagacaaaatagttgcttg

SEQ ID NO: 419 - DNA, 2943 bp, Arabidopsis thaliana
gtacacgctacttctctcaacaataacaaatcacacgcaccattaatacttcctcgacaacggaacgtgaacgcctttttttcactttcaaattcatcgatcggtatgggtattgagaagaggaagaagatggtgtggttttggccggagaagcacgagggtggagtgattaaggaggcggaggatgtggcggcggaacatatatcgagagaaggtacaatgagtcattacagttttagcaaaggtcttcttccgccgcttggagtcggagccaccgctcgctctagccgtcacattaagctccgctgcttcatcgtctctcctttcgatcctcgctacagagcttgggattggtttctagtgattttggtgctatacacagcgtgggcatctccttttgagttcgggttcctacaaacaccaagagcacctctcagtattcttgataacgtggtgaatggatttttcgctgtcgacattgttctgacattctttgttgccttcttggacaaggcaacttatctcctagtcgatgatcccaagagaatagcttggagatatacttcgacttggctgatttttgatgtggtatctacagttccttatgaactttttggcagcttattgcataacactattcaaggatatggaattttcagtatgttgcgtttatggcgtctgcacagggtcagtaaatgttttgccagattggagaaagatcgaaaatacaactacttctggattcgatgcacgaagcttctcctcgtttctctctttgtggttcattgtggcgcctgcttctgctattctattgctgcacattatccagacccttcaatgacatttatggcacttgcggaggcaaactggaaacagaaatctttgcttatccggtatgttacagcaatgtattggtccataacaaccttctccacaacgggttatggtgatatacatggtaataatgcagaagagagggccttcattctcttctacatgatctttaatcttggattgctagcttatataattggtaacatgacaaacttggtggttcacgtgaccagtcgcaccagaaactttagagataccattcaagctgcctcagcgtttgctcagaggaacaatcttccactgggcttgcaagaacagatggtagctcatttgtctttgaggtacagaaccgattcagaaggcctgcagcagcaagaaattattgattccctccccaaggctattcgttccagcatatcgcattatctgttctacgaagttgttgacaaaacctacttattccatggaatatccaatgatcttcttttccagttggtctctgagatgaaggcagagtattttcctcctaaagaagatgtgattttgcggaatgaagcaccgtcagacttttacataatggtcacaggagctgttgacatcattgcgcgtgtgaatggagtggatcaggtaaaatccgcatttttatttctcttttgtgacggtttttaagttgtgagttgtgtattctttgcaggtagttggtgaagcacagaccggccatgtttttggtgaagttggggttctatgttacaggccacagttgttcacagttcgaaccaaacgattgagtcaattgcttcgtctgaaccgtacagcattcttaaatcttgttcaggcaaacgttggtgatggggcaataatcatgaataatcttcttcagcatctgaaagactcaacagatccagtgatgaaaggcattttggctgagacagaactcatgttggctcaggggaaaatggatttacctctcagcttatgttttgcagcagccagaggagacgatttactgctgcatcagttgctgaaacgaggctcaaaccctaacgaaaccgataagaacggtcgaaccgcgttgcatatagcagcatcaaaaggaagccaatattgtgttgtattacttctcgagcatggagcagatcctaacattagagattcagaaggtagtgtaccattatgggaagcaatcattgggagacatgaagaaaatgctaaactcttatcagaaaatggcgcaacgctaagcttcgacacagtaggctatttctcgtgcttagccgttggacaaaacaacttaaatgcgctcaaagacattgtaaaatacggaggagatatctcactctcagatgtcaacggaaccacagctctgcacagagcagtctcagaaggaaacttggagattgtacaattcttgttagagaaaggagctgatatggacaagccagatgtttatggttggacggctcgtgctcttgctgagcatcaaggacatgaggatatcaaggctttgttttataatcagagaccagtggagaggaaaacgatacttgtttctggcacaccagagattaaaccattgatgaaacattccagtgagcctgtaatgactcaccatcattcaagggaagcaatgccgcctctggccagagccgtttctcagagacggaagctcagtaatttcaagaactcgctgtttggtatcatgtcagctgctaaaactggtgatgaaggaggagcatctaccaggactggaataagtgaaggagttggtggggtttatccggcgagagtgacaatcagtggtgaggcttcctcctccggtaaagtagtaaagttaccggattctcttgaagaattaattgaaattggtgagaagaagctgggattcgtagccacaaagattctgagcagagaaggagctgaaatcgacgacatcaggattataagagatggcgattttctccttcttcttaaggtttcttgatgacttcgcaaattcaatatgtaagaggatttaatatgttgtagtcattacaatagacggtatatccctgtcaacagtttttgtgagaggaagatcataaaaatgcaattcacttacttgcagaagaa

SEQ ID NO: 420 - DNA, 816 bp, Arabidopsis thaliana
ctatggctatatctatgggacatgctcggtgagcaaaacaataaacaaaagtaatcagaagatatctttgtaacatctttgaatttcgctaaaggaaaagagagagatttggtaaaaatgcagtcgatgaaagaaacagcttcgaatattgcagcttctgcaaaatctggcatggacaaaaccaaagctaccttggaggaaaaggcggagaagatgaagacacgagaccctgttcagaaacagatggctacacaggttaaagaagataagatcaatcaagctgagatgcagaagagagaaacgcgtcagcacaacgcggccatgaaagaagcggctggagccggaaccggtttaggtttggggacggccactcactcgaccactggacaagtcggacacggcactgggacacatcagatgtcggctctgcctggtcacggaacgggacaactgaccgaccgcgttgtggagggcacggctgtgaccgacccgattggaaggaacactggaactggtcggacaaccgctcataacactcacgttggtggtggtggtgccaccgggtacggaaccggcgggggatatactggataaacggtgttgttcacttgttctgttatttgctctgtttttgttgaatcgaaatttcgtggttttctgtcttactttcgtgttctgttttttttttttctttttcttgtgcttctgaataattgtaggacttcgatctcatctaggtttttgttgttggatgatagtcttactttatgagtagaatgttcatgcaatgtaacagtagtaaaattatccgttaac

SEQ ID NO: 421 - DNA, 1316 bp, Arabidopsis thaliana
ataaaccaactacttactatattgtccaaaagatcgacgaacataaaaacaaaaacatataatttgggtttttagagttcgaaacttgaaatctttttttttttggttgctgaggaatcgaagtagaagagtataaatgggtgttagagagaaagatccgttagcccagttgagtttgccaccaggttttagattttatccgacagatgaagagcttcttgttcagtatctatgtcggaaagttgcaggctatcatttctctctccaggtcatcggagacatcgatctctacaagttcgatccttgggatttgccaagtaagcaaacatgtttcacatttgtaggggagtataattgtaactatttaggtaaggctttgtttggagagaaggaatggtatttctttagcccaagagatcggaaatatccgaacgggtcaagacccaatagagtagccgggtcgggttattggaaagcaacgggtactgacaaaattatcacggcggatggtcgtcgtgtcgggattaaaaaagctctggtcttttacgccggaaaagctcccaaaggcactaaaaccaactggattatgcacgagtatcgcttaatagaacattctcgtagccatggaagctccaagttggatgattgggtgttgtgtcgaatttacaagaaaacatctggatctcagagacaagctgttactcctgttcaagcttgtcgtgaagagcatagcacgaatgggtcgtcatcgtcttcttcatcacagcttgacgacgttcttgattcgttcccggagataaaagaccagtcttttaatcttcctcggatgaattcgctcaggacgattcttaacgggaactttgattgggctagcttggcaggtcttaatccaattccagagctagctccgaccaatggattaccgagttacggtggttacgatgcgtttcgagcggcggaaggtgaggcggagagtgggcatgtgaatcggcagcagaactcgagcgggttgactcagagtttcgggtacagctcgagtgggtttggtgtttcgggtcaaacattcgagtttaggcaatgagagagatgtgaagttactgatgggtgaaaaaagtaaaaaaaaaacttggagatagtagagtggcaattgatgtaaataatagggatttatatggggcttttaccgattcggtgaggcttaggattccacaaaggaaaaaggctcgactggggactagtttgatccaacttgacggcccacaaatgtgtaatgtttctcaacggagagaaaaataaatggttaccaatatttttac

SEQ ID NO: 422 - DNA, 1719 bp, Arabidopsis thaliana
atagattttagaccttttagtctccaaagcataatagagatacaaagaaacaagaaaacgaaaggaaaaaatacagaaatgggtggtttgaagtttcatgtacttatgtatccatggttcgcaacaggccatatgaccccgttcctttttcttgccaacaaattggctgagaaaggtcatacggtcacttttttgattcccaagaaagctctgaaacagttggaaaatctcaatctgtttccacacaacattgtctttcgctctgtcaccgtccctcatgtggatggtctccccgttggcacagagacagtctctgagatccccgtgacatcagctgatctcttgatgtctgctatggatctcacacgtgatcaagttgaaggtgtggtccgagccgtggaaccggacctgatcttctttgacttcgctcattggattccagaggtagctagagactttggccttaagactgtaaagtacgtcgtggtatctgcatcgactatagctagtatgcttgttccaggtggtgagttaggtgttcctccgccgggatatccttcatcgaaggtgctgcttcgtaaacaagatgcttacaccatgaagaatctggagtctacaaatacaatcaatgtcggaccaaacttattggaaagagtcactacaagtcttatgaactctgatgtcattgcgataaggacagccagagaaatcgaaggaaacttttgcgactatatcgaaaaacattgcaggaaaaaggttctcttgacaggtccggtgttccctgagccagacaagactagagagctagaggaacgatgggttaagtggctaagtgggtatgaaccagactcagtggtgttttgtgcgttgggctcacaagtcattttagagaaagatcaattccaagaactctgcttaggaatggagctaacaggttcaccgtttcttgtagcggttaagccacctagaggctcatcaacgattcaagaagcacttcctgaaggattcgaggagagggttaaaggaagaggagttgtttggggagaatgggttcaacaaccattgctattgtctcatccatcagtcgggtgctttgtgagccattgtgggtttggatcaatgtgggagtctttgctgagtgattgtcagatagtcttggtaccacagttgggtgatcaggtcctcaacacaagattgctgagtgacgaactcaaggtttcggttgaagtggcaagagaggaaacaggatggttctcgaaagagagcttgttcgatgctatcaatagtgtgatgaaaagggacagtgagatcgggaatctggtgaagaagaatcacaccaagtggagggagacactaactagtcctggacttgtgaccggttatgtcgataatttcatagagtcattgcaggatcttgtctctgggaccaaccatgtttcgaagtagaagggagtgatcaataaggttggtacaaaccaaactatatatcttgaagtgcttctgtttccaagtgtgtttttgtttgtttgtatcatgtttctaagtagcagtaggggatttataaggttttataaaccaaaccttacttgaagtacctctgttttccctagttggctttataataatgtgtttcgtagttgtaagggcaagacaataaaatctcttaagaaaatagtttctaatccattaaagaacaaagggaagaaagagacaaagaaa

SEQ ID NO: 423 - DNA, 2043 bp, Artemisia annua
gaagaatagtttgagagtaacatcacctgataatttaaaagatacatatgaatgtgcgattggtaattttggagttcctcaatatggtggaactttaactggttttgttgagtatccgaaatccaatcaaaaggcttgtcaaacttttgattcttctttgaaatctcatgtttctggtggtcttcctctttttgtacttcttgatcgtggtgattgttactttactttgaaggcatggaacgcacaaaacgctggagctgcagctattcttgttgcagatgacagagccgagccattaatcaccatggatatgccagaagaggaaaatgcacgtgcagattacttacaaaacataacaatcccttccgcacttatcgctaaggcacttggggattcaataaagaaagctttaaccaagggcgatttggtaaatataaaactcgattggacagaagctctccctcaccctgatgagcgtgtagagtacgagttttggaccaatagcaatgatgaatgtggagccaagtgtgatagtcaaataaattttgtgaaagagtttaaaggggcagctcaaatacttgagaaaaaaggctacactcaattcacaccacattatatcacttggtattgccctgaggctttcacattgagcaaacagtgcaaatcacaatgtatcaaccatggaagatattgtgctccggatcccgagcaagattttagtaaagggtatgatgggaaagatgttgtggttcaaaatttgaggcaagcttgtttttataaagtaacaaatgaaactggaaagccttggctttggtgggattatgttactgatttttctatccggtgtccgatgaaagaccagaagtacacaaaagagtgtgcagaggaagttattaagtcgcttggtgttgatttaaagaaaataaatgaatgtgtcggtgatacagaagctgatgttgataacgcagtcctcaaggctgagcaagaagcacagataggcaaagggtcacgcggagatgtcactatactgccaactcttgtgataaacaacagacaatatcggggyaagcttgcaaaacaagcagttctaaaggccatttgctcargatttgaggagaccactgagccagccgtatgtttgagtgatgatatgcaaacaaatgagtgcctagagaacaatggtgggtgctggatggacaaagctgctaatattacagcatgcagggatacttttcgtgggagagtttgtgaatgcccagttgtgcagggtgtcaagtttgttggtgatggttataaacactgtgaagcatcgggggcactccgctgtgaagttaacaatggaggctgttggaaaagcactcagcaaggcagaacctactctgcttgcatcgatgaccacaccaaaagttgcgagtgtccaccagggtttaaaggagacggagttaacagttgtgaagatattgatgaatgcaaagagaagacagcgtgccaatgttctaactgtaaatgcaagaatacatggggcagttacgagtgtagttgcagtggtaatctgctctacatgagagaacatgacacttgcataagtaaagatggtaaatcagaagtcagttggggattcgtatgggtcataattcttggtctggcagctgctggaaccgcaggatatgcattctataagtacagggtccggacatacatggattcggagatccgggctatcatggcacagtacatgccattggacaaccaggcagaagttgagattcacggaactcacggaaatgtgtaaaggaagttgcttatgtaaaacaagatacaaatccagatgatgggtgcacccagtttaaggatccacgaccaagtttatttaatttaaggttttggtttgttagttatgaccatgcttgtgtctttctatgtatatgtcaactttttctcgacaatcatgaaattctcaggttagcagactaaacatctttgtgattgaggttctttatttatgatagcatactaaataaaacccagttttaaccttcgtgt

SEQ ID NO: 424 - DNA, 1468 bp, Artemisia annua
acaagcgcctactttcaatgctggagttaaactgtttgaaggggaggggaggattgtcsgccctaatgaagtggaggtgatacagttggatggcactaaactgtcctatacagcaaagcatatactaatagcaactggtagcagggcacagcgaccagatattcctggacaggagttaggtataacctcagatgaagctttaagcttggatgagttaccaaagcgagttgtcatacttgggggagggtatattgctgttgagtttgcttcaatttggcgtgggatgggttctaccgtaaatctatgtttcagaagggaacttccattgaggggttttgatgatgaaatgagagctcttgttgcaagaaatctcgagggcagaggcataatcttgcacccacagacaaccttgacaaagctggtaaaaacagaagatggcataaaagttactacagatcatggtgaagaattattggcagatgctgtacttttcgccactggacgaatccctaattcaaagaggctaaatttgcaagctgtaggtgttgaagttgacaaaacaggagcggtgaaggtcgatgagtattctcgcaccaatgtgcctagcgtttgggccattggtgatgtcacaaatcggatgaatcttactcctgttgccttgatggaaggaactttgtttgctaaaactgtctttggtaatgaacctagcaagcctgactacagcaatataccttgtgctgttttctgcataccacctctctcagttgttggactaagtgaagaacaagccattgagcaagccgatggggacattttggttttcacatcaggatttaatcctatgaagaattccatctctggacggcaggagaagacactcatgaagcttattgtcagcgctgagacggataaagttcttggtgcatcaatgtgtgggccagatgcagcagaaattatgcagggcattgctgttgcactcaaatgtggagcaaccaaggcacaattcgatagcacggtggggatacacccttcatcagcagaggaattcgtcacaatgcgatcagtcactaggcgtattgctgctgccggcaaaccaaagaccaacctttaaacgcgtagtttcagttggttagttgttcctcatcaataaacgaattgggtatacaatattttggttcacaagctgcaataacattattattattagcacatgaatattgtgggttgcttttattttttaagtatgtgatttctcggatcttctagagattgttaataggaagttgaatgaaatagtcaaggtaatggaatgagcattggaatgaaatggtccaatactaactcattattatgtttatttttacctgtaaggatgaattgaacacatctagagtgtcgttttgttttgrgtatgtcrtaaatagactttgracggtaggaaataaatgaaagtwtggttgaaaaaaag

SEQ ID NO: 425 - DNA, 684 bp, Artemisia annua
ctctccttcaatttcgccccaactactcaattttcaattttataaaaattggggttaattaatttgatttagatcagataataaaaattaaaaagagatgagtttccaggatcttgaagcgggtcgggtaagaagatcaaacaatggatatacaaatgggtttaagcaaatggatccgacccaagcaatagcttcagggatatttcagattaatactggtgtaaatacttttcaaaggcttgttaatactcttggtactcctaaagatacacctgagcttcgtgataaattgcacaagacaaggttacatattgggcaattggtgaaggacacctcagataaactcaagaaagctagtgaaacagaccatcgtgcggaagttagtgccagcaaaaaaattacagatgctaaacttgcaaaagattttcaagccgttttgaaagaatttcagaaggctcagcgccttgcagcagaaagagagacggcttacgttccttttgttccgcaagccgttcttccatcaagttatgcagcaagtgaaatggatgtaaggtcagacaaagatccagaacagcgcgctcttcttgtggaatctagaagacaggaggttttgctgctggacaatgagattgcatttaatgaggctattatcgaggagagagatcaaggaatacaagaaattca

SEQ ID NO: 426 - DNA, 1703 bp, Artemisia annua
gtgacaaattattattcaaatcattatgccattatcatactactggcaacaaatagtaaaatgagagttgaaaggtctgcatttcagttcaagttcatggcacttgtgctgctgcttgtgttgttttcattcttgaatcttgcatcatcagagatcatctttgaagaaagatttgatgatgggtggcagagccggtgggtgaagtctgattggaaaaaaagtgaaggaaaggctggttcgtttaagcacacggcagggtcgtggtctggtgatccggatgataaaggtcttcagacaacaactgatgcaagacattttgccatctctgcaaagatacctgaattcaacaacaaaaatagaacgctcgtgttacagtactcagtcaaaattgaacaagatattgagtgtgggggtgcttatatcaagcttatgtctggatatgtcaaccaaaagaaatttggtggtgacactccttatagtgtgatgtttggaccagatatatgtggcacacagacaaagaaacttcatgtgattctgtcataccaggggcaaaattatcctctaaagaaggatttgcagtgcgaaacagacaagttgacccatttctacacgtttgttcttaggccagatgcaagttatagtatcctaatagatggcagagaaagagactcagggagcatgtatacagattgggacatccttccaccccgtaaaatcaaggacgtgactgccaaaaagcctgcagactgggaggaaagagagtatattgaagatccaaatcaagtcaagccagagggatatgattcaatcccaagagaaattcctgaccccaaagctaaacagcctgatacttgggacgaagatgaggatgggatatggagagcaccaaagataccaaatccagcatacaaaggcccatggaaaccaaagaaaattaaaaatccgaactacaaggggaaatggaagaccccctggattgataacccagaatttgaagatgatcctgatctatatgtgctcaagcctattaagtatgtgggaattgaggtttggcaggtgaaagctggagctgtttttgacaacattctgatctgtgatgatcccgagtatgcaaaagatgtggtacaagaagttttcaccaatagagagatggaaaaagaagcattggaggaagccgagaaaattaaaaaagcaagagaggaagaggaagcacaaagggcaagagaggaaggtgaaaagaggaaaagagaacgaggttatgatagaaggcgccgggataaggaccattacagggacagataccgaaagcgccattacgatgactatcatgatgagctgtgagcctgtgagatgtgacgattcatttattgtagtaggcatttatcaccggcctactggacaatataggtcatgttccgttttcatctttacatgtaacacgcgaaatgttgtactctgtatgtcgaactatcggataagaattctatttggtactacatggtatttttttctttataggcaacgttttgctaatgcaaatttatgtgaatttggagcacggtttttggtttcctctatacgatagccatattattttcttgagttttggtttttcccattggtttctgtttacctagaaaaatgtaaatcatagtctagggtcttatatgtaataaatgtaatagtttaaggtttggttgtgt

SEQ ID NO: 427 - DNA, 537 bp, brassica juncea
gactgctttttaacacaatatagagaacactagtagtgtgacaggcaagagacttctgaaccaaatctaaagagctcaacacacagcaaaagagaactaggtaaagagctgttgagttgtttctttggtgtgcagatggaaacagagaaaaagaacagcaaggagctagggcttaaccacctagggttcgtgagagttgcagcgatccaggttcttgttagcctctcaaacctctacgactacgccaaacaaaactccggtcctcttaaaccggccgtgggaaaggtggaaggagccgtcaccaccgtcgtcacccctgtcttcaacaaattcaaagatgttccagatactytcctcctctttcttgatcayaaggtaggtgaagtttcgaacaagtttgataagcatgctcctccactggctaagcaagtagtgagtcaagcacatgtactgatccagatgactacagagaaggctcaaagctttgtgaaagaggctcgtaccggtggtcctaaagctgcctttaactatgctgaa

SEQ ID NO: 428 - DNA, 521 bp, brassica juncea
gacgaagaatcgtaagctatctttttgtaacatctttgaatctcactaagtaagttggaaaaaaatgcagtcgatgaaggaaacagcttcaaacatcgcagcttctgccaagtcyggcatggacaagaccaaagccaccktggaggaaaaggctgagaagatgacgacacgagatcctattcagaaagagatggctacacagaagaaagaaggaaggatcaaysaggctgagatgcaraagagagaagcgcgtgarcacaacgctgycatgaaagaagccgctggagctggaaccggaaccggtttgggactggggtcggccactcattctactacaggacacgttggacacggaactgggacacatcagatgtcggctttgcctggtcacggcacgggacaaccaacgggacatgttgttgatggtacagctgagacagaaccgataggaacgaacactggaactggtaggaccacagctcataacacccgtgttggtggtggcaccactgggtacggaa

SEQ ID NO: 429 - DNA, 1579 bp, brassica juncea
taagactatgaagaaaggtgaaaacgctgtgttcaccatcccttcggagctggcgtatggtgaatctggttcgccgccaaccattcctgccaatgccacgcttcagtttgatgtggagttgctctcttggtctagtgtcaaagacatttgcaaagacggtggcgtgtttaagaagattgttgctgctggggagaagtgggaaaccccgaaggatctcgatgaagttcttgttaagtatgaggctaagctcgaggatggtacggttgttggcaaatctgatggtgtagagttcactgttaaagacggttacttctgtcctgcacttgctaaggctgtgaaaaccatgaagaaggcagagaaggttcttctgacagtcaagccacaatatggtttcggggagaagggcaagccagcttctggtgctgaagccgctgttcctccgaatgcgacacttgagatcgaactggagttagtttcctggaagacagtttctgaagtgactgatgataacaaggtcatcaagaaaatcttgaaagaaggagaaggatatgagcgtcccaacgagggggcggttgtgaaagtgaaattgatagggaaacttggagatggtactgtattcctaaagaagggtcacggtgaaagtgaagagctctttgagttcaaaacagatgaagagcaagtgatcgatggacttgatagagccttgatgaagatgaagaagggtgaagtggcattggtgaccatagacccagagtatgcttttggttcaactgagtctaagcaggaattagctgtggtgccgccaaactcaaccgtctattatgaggttgaccttgtgtctttcgacaaggaaagggaatcgtgggacatgaacactgaggagaagattgaagctgccggtaagaagaaggaagaaggaaatgccaagttcaaagcaggcaaatacgcactcgcttccaagagatacgagaaggctgtcaaattcattgaatacgactcatccttcagtgaggaggagaagaagcaagcaaaagcattgaaagtggcgtgcaatcttaacgatgcagcttgcaaactgaagttgaaagaatacaggcaggctgaaaagctatgcacaaaggtgctagagctggaaagcaccaatgtgaaggccctatacaggagagcgcaggcttacatggagttggctgatttggacttggctgagtttgatgtcaagaaggcccttgaagttgatcccgacaacagggaagtgaaggtggagcagagaaggctgaaggagaaaatgaaggagtttaacaaaaaggaggccaagttttacggaaacatgtttgcaaaactctctaagtgaagcagcaaagcatcgtggagaatggttcactggctttggatgtttttctcttttctgtacctttgcctaatttcgatcaagttgtgtttttttagataagactcctcaagacattgttgttctttataaaaatgttagcgtttgataatttttaatcgagatactcgtcgtccacttctgtgaaacgattagaattcatcaagcagatttttactatgttgatttaca

SEQ ID NO: 430 - DNA, 1452 bp, brassica juncea
agattggtggtgttggtggaacgtgtgttattcgtggttgtgttcctaagaagattctcgtctatggtgctacttatggtggtgaatttgaggatgctagaaactatgggtgggaaatcaatgagaatgtggacttcacatggaagaagcttctgcaaaagaagactgatgagatattgagactgaacaatatttacaagcggttgttggcgaatgctgctgtgaagttgtatgaaggtgaaggaagaatagttggtcccaacgaagttgaggtcagacagatcgatggtaccaaaataagttacaccgccaagcacattttgattgccactggcagtcgggcacagaagcctaatattcctggacacgagctggctattacatctgacgaagctttaagcttggaagaatttcctaagcgtgctgtagtgcttggaggagggtacattgctgtggagtttgcatcaatatggcgtggaatgggtggtacagtggatttattctttaggaaggaacttccactaaggggctttgatgatgaaatgagggcactagtggctagaaatcttgaaggaaggggtgttaatctgcatccgcaaacaagtttgactcagttgacaaaaacagacgaggggatcaaagtaatctcgtctcacggggaagaattcatggcagatgttgtactatttgctactggcaggaatcctaataccaagagattgaatttagaagctgttggtgttgaacttgatcaggctggagctgtgaaggttgatgagtactcacgcactaacatacctagcatatgggctgtgggagatgctacaaaccgaattaaccttacacctgttgcgttaatggaggccacctgctttgcgaacactgtctttggtgggaagcctacgaaagcagactacaccaatgtagcctgtgctgtattttgcataccaccattagctgtggtgggtctcagcgaagaagaggcagtagaaaaagcgactggggatattctggttttcacctcaggctttaatcctatgaagaacaccatttctggacggcaggagaagtcattgatgaagctaatagttgatgagcagactgataaggttattggagcatccatgtgcggtccagatgcagctgagatcatgcaggggattgcaattgcgctcaagtgtggagcaaccaaagcacaatttgacagcacggttgggatacatccgtcttctgcagaggaattcgtgacaatgcgaactgtgaccagacgcattgcctacaaagccaaacccaagacgagtctatgaacctccaaaatttaaaaagacagtctgcatgaaacactttaagtttgatcagagagtcagacagacacatgagtttcctcatatttatgtcccaaacaattgatttgtagtttttatgtgttcttttgatgtttctcttatggcc

SEQ ID NO: 431 - DNA, 249 bp, brassica juncea
ccttggaggagaaggctgagaagatgacaacaagagaccctcttcagaaagagatggctacacagaagaaagaagggaggatcaatgaggctgagatgcagaagggagaagcgcgcgagcacaacgctgtcatgaaagaagccagtggagctggaactggaaccggtttgggaatgggaaccgccactcactcgaccactggacacgttggacacggaactgggacccatcagatgtcggctttgccta

SEQ ID NO: 432 - DNA, 1916 bp, Brassica oleracea
gactcacccgaatatataaaccacgttaccaacctcaactctcctcacaaactcttctcttgcgattcgtttactttcgtgctttttgaatcgagatggatgaagatttcgagatgcctcccgtcggtggaatgaacggcgacgacgagatggatttcggcgacgacgcctccttcctcaaagtcggcgaggagaaggagatccagcaaggcttgaagaagaagctcctcaaggaaggcgaaggattcgagactccggagaacggcgatgaagtcgaagtgcactacactggtactttgctcgatgggaccaagttcgattccagccgcgaccgaggaacgcctttcaaattcactctcggtcaaggtcaggttattaaaggatgggatattggtattaagactatgaagaaaggcgaaaacgctgttttcactatcccttccgagctggcttatggggaatctggctcgccgccgaccatccctgccaatgccacgcttcagtttgatgtggagttgctttcttggtctagtgtcaaggacatatgcaaagatggtggtgtgtttaagaagattgttgctgcgggagagaagtgggaaaccccaaaggatctcgatgaagttcttgttaagtatgtggctaagctcgaggatggtactgttgttgggaaatctgatggtgttgagttcactgttaaagacggttacttctgtcctgcacttgctaaggctgtgaaaaccatgaagaaggcagagaaggttcttctgactgttaaaccacaatatggtttcggggagaagggcaagccagcctctgctggtgaagctgcggttcctccaaacgcgacgcttgagatcgagctggagttagtttcctggaagacagtttctgaagtgaccgatgacaacaaggtcatcaagaaaatcttgaaagaaggggaaggatatgagcgtcccaatgagggggcggttgtgaaagtgaaactgataggtaaacttggagatggtactgtgttcctaaagaaaggtcacggtgaaggtgaagagccctttgagttcaaaacagatgaagagcaagtgatcgatgggcttgataaagctctgttgaagatgaagaagggtgaagtggcattggtgaccatagacccagtgtatgcttttggttcaactgagtcaaagcaggaattagctgtggtgccgccaaactcaaccgtctattatgaggttgaccttgtgtctttcgacaaggaaagggaatcgtgggacatgaacactgaggagaagattgaagctgctggtaagaagaaggaagaaggaaatgccaagttcaaagcaggcaaatacgcactcgcttccaagagatacgagaaggctgtcaaatacattgaatacgactcatccttcagcgaggatgagaagaagcaagcaaaagcattgaaagtggcgtgcaatctgaacgatgcagcttgcaaactgaagttgaaagaatacaggcaagctgaaaagctatgcacaaaggtgctagagctggaaagcaccaatgtgaaggccctatacaggagagcgcaggcttacatggagttggctgatttggacttggctgagtttgatgtcaagaaggcccttgaagtcgatcccgacaacagggaagtgaaggtggagcagagaaggctgaaggagaaaatgaaggagtttaacaaaaaggaggccaagttttacggaaacatgtttgcaaaactctctaagtgaagcagcagcatcgtggagaatggttcactggctttggatgtttttctcttttctgtacctttgcctaatttcgatcaagttgtgtttttttagataagactcctcaagacattgttgttctttattaaatgttagcgtttgataatttataatcgagattctcgtcat

SEQ ID NO: 433 - DNA, 690 bp, Brassica oleracea
  misc_feature (627)..(627): n is a, c, g, or t
cgtccgcccacgcgtccgaaagagctctcagcacaaactaggtaaagagctgttaagttgtttctttggtgtgtagatggaaacagagaaaaacagcaaggagctagggcttaaccacctagggttcgtgagagttgcagcgatccaggttcttgttagcctctcaaacctatacgactacgccaaacaaaactctggtcctcttaaaccggcggtgggaaaggtggaaggagccgtcaccaccgtcgtcacccctgtcttcaacaaattcaaagatgttccagatactcttctcctctttcttgatcacaaggttggtgaagtttcgaacaagtttgataagcatgctcctccactggctaagcaagtagtaagccaagcacatgtactgatccaggcgactacagagaaggctcaaagctttgtgaaagaggctcgtactggtggtcctaaagctgcctttaactatgctgcagccgagtacaagtacttcgttgtgactaactcggttaaagtctgggctaaactcaaccagtacaaacctattcatgcagtgggaaacaaagctttgccactggctgcaaacttgtctggtatgtacaacgatttggtgactaacatgaccangatgggttaccctgtggttggttatcttcctttggttcctgttgatgacattgtcaaggctta

SEQ ID NO: 434 - DNA, 606 bp, Brassica oleracea
  misc_feature (29)..(29): n is a, c, g, or t
  misc_feature (229)..(229): n is a, c, g, or t
aagcaagtagtaagccaagcacatgtacngatccaggcgactacagagaaggctcaaagctttgtgaaagaggctcgtactggtggtcctaaagctgcctttaactatgctgcagccgagtacaagtacttcgttgtgactaactcggttaaagtytgggctaaactcaaccagtacaaacctattcatgcagtgggaaacaaagctttgccactggctgcaaacttgnttggtatgtacaacgatttggtgactaacatgaccaagatgggttaccctgtggttggttatcttcctttggttcctgttgatgacattgtcaaggcttatgaaaaggaacaagatgcagcgcaaaagaaaggagatactacccctgctactgatgggaacaaatcatcttttgattcggacactgattgaaacatttgtgagcctggtttgttgggtttggtaacttgtgtaaatgatcttattaggctctttcttgttcttctttgatcacagaacttggtcttgcagtgtttcatttgttgttggttgatgtgtgtattttctatctatgtaacaaagaaggtaataatattgagcaacaaaacctttaagaat

SEQ ID NO: 435 - DNA, 620 bp, Brassica oleracea
  misc_feature (19)..(21): n is a, c, g, or t
attaacaccgatcgaaacnnnaaaataaagttgtagcgagaaagaatcaacatggcgagtttactagataaggcaaaagatttcgtggctgataacctcgccggggttcctaaaccggagggttcggttacggacgtcgaccttaaagacgtgaaccgtgactccgtcgagtacttagccaaagtttcagtcaccaatccttacggtcacgcgattccgatctgcgagatcaatttcactattcacagcggtggccgggaaattggaaaggggaagataccggaccctggttcactgaaagcaaaggacatgacggttcttgatgttccgatcgtagtgccgtatagtatactgttcaacttggctcgagacgttggtgcggactgggacattgactatttgctcgaaataggtctctccattgatcttcctgttctcggggattttactattccggttaccagcaagggcgaaatcaaactccctacttttaaagactacttctgagtcaactttacgctgttaaaaacaaaacaaaaacaaatatcgtttgtactagtgataaaatgtaataactaataagtgtggtttgcctataaaatcattaaatatcaaaaaaa

SEQ ID NO: 436 - DNA, 1795 bp, Brassica oleracea
  misc_feature (1757)..(1759): n is a, c, g, or t
gaatcgtgtctgtgtgtctctcttctctagaggatcttcttcttcttcttagagattttggatatctgattcagcacaatcatggggaggaagatgcttgccgatggagagcttgacaaggcggtggcggcggaggaagccacggagactcactatgatttcgatttgtttgtaatcggcgcggggagcggcggtgttcgtgcagctaggttttccgctaataatggcgctaaggttggtatctgtgagcttccttttcaccctattagctctgaggagattggtggtgttggtggaacgtgtgttattcgtggttgtgttcccaagaagattctcgtctatggtgctacttatggtggtgagcttgaggatgctagaaattatgggtgggaaatcaatgagaatgtcgacttcacatggaagaagcttctgcaaaagaagactgatgagatattgagactgaacaatatttacaagcgattgttggcgaatgctgctgtgaagttgtatgaaggtgaaggaagaatcgttggtcccaacgaagttgaggtgaggcagatcgatggtaccaaaataagttacaccgccaagcacattttgattgccactggcagtcgggcacagaagcccaatattcctggacatgagctggctattacatctgatgaagctttaagtttggaagagtttcctaagcgtgctgtagtgcttggaggagggtacattgctgtggagtttgcatcaatatggcgtggaatgggtggtacggtggatctattctttaggaaggaacttccactaaggggctttgatgacgagatgagggcactagtggctagaaatctggaaggaaggggtgttaatctgcatccgcaaacaagtttgactcagctgataaaaacagacgacgggataaaagtaatctcgtctcacggagaagaattcatggcggatgttgtactatttgctactggcaggaatcctaataccaagagattgaatttagaagctgttggtgttgaacttgatcaggctggagctgtgaaggttgatgagtactcacgcactaacatccctagcatatgggctgtgggagatgctacaaaccgaattaaccttacacctgttgccttaatggaggccacctgctttgcgaacactgtttttggtgggaagcctactaaagcagactacagcaatgtagcctgtgctgtattttgcataccaccactagctgtggttggtctcagcgaagaagaggcagtagaaaaagcgactggtgatattctggttttcacctcaggctttaatcctatgaagaacaccatttctggacggcaggagaagtcattgatgaagctaatagttgatgagcagactgataaggttattggagcatccatgtgcggtccagatgcagctgaaatcatgcaggggattgcaattgcgctcaagtgtgaagcaacaaaagcacaatttgacagcacggttgggatacatccgtcttcggcagaggaattcgtgacaatgcgaactgtgaccagacgcattgcctacaaagccaaacccaagacgagtctatgaacctccaaaatttaaaaagacagtttgcataaaacattttagtttgatcagagagtcagacagaaacatgagtttcatcaatacttttgtccccaataaatgatttgtagtttttgtttgttgtttgatgtagacctttataattatctgcatcatctttgaataaagaaacnnngctctttggttatatcatgttcttgaactggtttgt

SEQ ID NO: 437 - DNA, 1521 bp, Brassica rapa
  misc_feature (1456)..(1456): n is a, c, g, or t
agacacacacacacacaagagatagagagagagagactatcatctttcccaaatttcgatttattattttctcgaatattccagcaaaaaaataaagaaataatgaattcagaatcgttagaaaatctccaccgaccactgattgaatttcctcttccaccttgccgctccggcgatcttcgtctacgtcatcaacaacggaatgtccatcctcactcgtatcttcgccggcaacgtaggcagctcccaactcgccgccgcttcactcggaaacagtggtttcaacatgttcacttatggacttctgctcggtatgggaagtgcggtggagacgttgtgtggacaagcgcatggagctcatcgttacgagatgctcggcgtttacctccagagatcaacggtggttctcatcatcacctgtctcccgatgtcgctcctcttcatcttctcgaagcctctcctcaacacactcggcgagccagaacaagtcgcgtcaatggcttccgtcttcgtctacggcatgatcccagtgatattcgcctacgcggttaacttccccatccagaagttcctccaagcgcagagcatcgtcacgccgagcgcttacatctccgccgcgactctggtcattcaccttgtcctctcgtggatcgctgtgtatcgactagggttcggtctcttggctttgtctttgatccatagcttgtcgtggtggatcatcgtcgcggctcagattkkttacatcaagatgagtccgagatgtcaacggacgtgggaaggttttagctggaaagcttttgaaggtctttgggactttttccggttatcggcggcttcagcggtgatgctctgcctagagtcgtggtactctcagattcttgctttactcgccggacttctcaagaaccctgagcttgctttggattctttagctatatgcatgtcaatttctgcaatctcattcatggtctctgttggattcaacgcagctgcaagtgtgagagtaagcaatgagttaggagctggaaacccaagagcggctgcgttttcaacgtttgtaacgacaggagtatcattactgctagcggtttttgaagccgttgtggtcatgtcgtggcgaaatgtcatcagctatgcgtttactgatagtcctgaggtggccgaggccgttgcggatttatctccctttttagccatcaccattgtcctcaatggagttcagcctgttttgtcaggtgtggctgttgggcgtggatggcaagcatttgtggcgtacgttaacattggttgttactacgttgtgggaattccgattgggttcatacttggtttcacctatgatatgggagcaaagggaatatggacagggatgattggtggcacattaatgcaaaccataatcctagtgattgttacctttagaactgattgggataaagaggtggagaaagcttcnagccgtctggaccgatgggaagagagccgtgagccgcttctgaagcagtaaacatggacaatatt

SEQ ID NO: 438 - DNA, 713 bp, Brassica rapa
tctacgactcatcccttgaacaagacattgcttcctctgttccctttcctcttgcaaagttgctggtgacattagcaacttcattcagatatgataaagagaaggttgacaaggaagttgctacaatagaggccggtatgctacatgaagccatatcaaaaaagcaactagatcatgatcatgtcctttacattataggaactcgcagtatctaccagctcagagcaacctttgttgcttacaagcagagttatgggaacacattagataaggatgttgatggatgtcctggagatgctgatctgagaagtctattgcagatggtgatcttgtgcattgagttccctgagaaacactttgcaaaggttgtaagagattcgattgaggggtttggaacagatgaagattcgttgacgagagcgattgtgatgcgtgcagagattgatttgatgaaagtaagaggagagtatttcaatatgtataacgcaagcatggataacgctatcattggtgatgtttctggtgactacaaggacttcctcatgactctacttggttccaaaatctgatctttgtttgaattttaatattcttggcttggcttgtgaattgtgacttgtattaaagacttcattttctgattcagatttgataaaacatgttataaaaataatcaaaactactcttggtttttgaattttttatgaaaaaac

SEQ ID NO: 439 - DNA, 1077 bp, Brassica rapa
aaagatcgacgaacataaacatataacttttcttggtttttaagagttcgaaagacttttagattgttttgtctgctgaagaatcgaagttagaagaaatgggtgttagagaaatggatccgttagcccagttgagcttaccaccgggtttcagattttacccgacagatgaagagcttcttgttcagtatctctgtcggaaagttgcaggctatcatttctctctccaagtcatcggagacatcgatctctacaagttcgatccttgggatttgccaagtaargcyttgtttggggagaaggaatggtayttctttagyccaagagaycgraaatatccraacgggtcaagacccaatagagtwgccgggtcrggttaytggaaggcracgggtaccgrcaaratcatcaygtcggatggycaccgtgtcggrattaaaaaagctctgrttttctacgccgggaaagctccaaaaggcacgaaaacaaactggattatgcacgagtatcgactcatcgagcattctcgtagccatggaagctccaaggtaacaacaacacattactgaaaattgtaaaaacatataaatcgaaatcaaaaagctaaatttgttttcttacagttggatgattgggtgttatgtcgaatctacaagaaaacatctggatctcagagacaagctgttgcttctccggtacaagcttgccttgaagaccagagcacgaacatgtcgtcgtcgccgtcttcttcgtctcagctcgacgacgttcttgattcgttcccggaratgaaagatcggtctttkgatcttcctcggatgaattcgctcaggacgattctcaacggcaatttcgaatgggctagcttagcaggtcttaatcccatgcctgagctagctccgatgacctacggtttatcgaattacggaggttaccacgcgttccaatcggcggagagcgggtgtaggagttcgcaggtcgatcaggagcagaactcgaccgagttgactcagagtctcgggtacagctcgagcgggttcggactttcgggtcaaatgtacgagtttaggcaatccg

SEQ ID NO: 440 - DNA, 989 bp, Brassica rapa
tagaagagacttctgaaccaaatctaaagagctcaacacacagcaaaagagaactaggtgaagagctgttgagttgtttctttggtgtgtagatggaaacagagaaaaagaacagcaaggagctagggcttaaccacctagggttcgtgagagttgcagcgatccaggttcttgttagcctctcaaacctctacgactacgccaaacaaaactccggtcctcttaaaccggccgtgggaaaggtggaaggagccgtcaccaccgtcgtcacccctgtctacaacaaattcaaagatgttccagatactctcctcctctttcttgatcataaggtaggtgaagtttcgaacaagtttgataagcatgctcctccactggctaagcaagtagtgagtcaagcacatgtactgatccagatgactacagagaaggctcaaagctttgtgaaagaggctcgtaccggtggtcctaaagctgcctttaactatgctgcaactgagtacaagtacttcgttgtgactaactcggttaaagtctgggttaaactcaaccagtacaaacctattcatgcagtgggaaacaaagctttgccactggctgcaaacttgtctggtaagtacaacggtttggtgactgacatgaccaagattggttaccctgtggttggttatcttcctttagttcctgttgatgacattgtcaaggcttatgaaaaagaacaagatgcagcgcagaagaaaggagatacgaccaccacccctactgatggaaacaaatcctcgtctgattcggacactgattgaaacatttgtgagtctggtttgttgggtttggttacttgtgtaaatgatcttattaggctctttcttgttcttctttgatcacagaacttggtcttgtagtgttttcatttcttgttggttgttgatgtgtgtatttcatatctatgtaacaaagaaggtaatattgagcaacaaacctttaagaac

SEQ ID NO: 441 - DNA, 810 bp, Brassica rapa
atggggagaaattattctcacttccgttttgtttttgtcttccgtctccagatctctttctcagatwcatagcccaaagtcaaccagtcaacaaaaagtctcttcctttgctgagaaktcaaggggttttttttcgatgatagcgaggatcctcgccggtttcatggagrgtccggcggtggctgctgccggcgactctgttctaggtacaatcaaaatcgccgtgatgcctatagctaaagtgttcaccatgtgcttcttgggtcttctcatggcttctaagtacgtcaacatcttgcctccctctggccgcaaactcttgaacgggttggtcttctcgcttttgcttccctgcttgatcttctcccagctcggacaagctgttactctccagaagatgcttcaatggtggttcattccggtgaacgttgttcttggtacaatctcagggtctttaattggcttacttgttgccaccattgttcgtcctccttacccttatttcaagttcaccatcatacaaatcggagttggtaatatcggcaatgttcctcttgtgttactagcggctctatgtagggacacctccaacccctttggtgactctgaaaaatgtagcattgatggcactgcytayatctcttttggtcaatgggttggtgccatcatcctctacacatatgtgtaccagatgtttactcctccccctgaaggttttgacggagaagaagaaaatctacctttgaaaaacgctgcttctccagagcaagtccccttgcttactcataactatcccaaggacactccacc

SEQ ID NO: 442 - DNA, 1327 bp, Brassica rapa
atcttacatttctcagtctcttctatctcctgccacttaaaactgaattaacagaatgaacggtggtcatctccccaccgccgcttccgacgatctgaaatctcccctcttgccggttgtccataatgacgaaccattcgaaaaacaaacgctggggcaccatctccggacaatattcacacccaaaaactgttacatcgctcttggtcctcttctttgcgccgtcgtgtgtctatgcgcacggctcggcggagaagatacgacgactgcgaagaacatgctaggagttcttgtgtggatgttcgcgtggtggttgacggaagccgtcccgatgcccatcacctccywgtcgccgctttttttattcccactcttcggaatcacgacggctgatcatgtggcaagttcttacatggatgacgtcatttccctcgttcttgggagctttatcctcgctcttgccgtcgaacactacaacatccatcgtcgacttgctctcaacataacgatggtattctgcgtggagcctctaaacgcgccgctgcttcttctcggcatctgcgcaacaacggcgttcgtgagcatgtggatgcacaacgtggcggccacggtcatgatgatgccagtcgctacagggatactccagagactgccctcgtcgccatcttcgtcatcggaaatggtgcctccggcagtggggaagttttgccgagcggtggtgctcggtgtgatatactcagcggtcgttggtggaatgagcacgctgacaggaacaggcgtgaatctgatacttgtcggaatgtggaaaagctacttccctgaggctgatccaatcagtttcagccaatggttcttcttcggtttcccgctagctttgtgcttattcgtggtgctttggggtattctatgtgtactgtattgtcctaaagggtcagggaaacttctctctccttatcttcacaagtcccatcttcgtacggagcttgagatgttgggaccaatgagtttcgctgagaagatggtcttgtctgtgtttggtggtttggttgtgttatggatgacaaggaatataaccgacgacatccccgggtggggttgcattttcaacggccgagtcggtgatggaacggtgagtgtgatgatggctacgttgctgtttataatcccaaacggtattaaaaagggagagaagctaatggattggggtaaatgcaagaagcttccgtggaacatagtgttgttactaggagctggattcgctatagccgatrragtacgtacaagtggcctagctgaagttttatccaaaggactcgtgttctgaaac

SEQ ID NO: 443 - DNA, 1066 bp, Brassica rapa
ctcttctctttgcgattcgtttactttcgtgctttttgaatcgagatggatgaagatttcgagatgcctcccgtcggtggaatgaacggcggcgacgagatggacttcggcgacgacgcctccttcctcaaagtcggcgaggagaaggagatccagcaaggcttgaagaagaagctcctcaaggaaggccaaggattcgagactcctgagaacggcgatgaagtcgaagtgcactacactggtacgttgctcgatgggaccaagttcgattcaagccgtgacagaggaacgcctttcaaattcactctcggtcaaggtcaggttattaaaggatgggatattggtattaagactatgaagaaaggcgaaaacgctgttttcaccatcccttcggagctggcttatggtgaatctggctcaccgccgaccatccctgccaatgctacgcttcagtttgatgtggagttgctttcttggtctagtgtcaaggatatatgcaaagatggaggcgtttttaagaagattgttgctgcgggggagaagtgggaaatgcctaaggatctcgatgaagttcttgttaagtatgtggctaagctcgaggatggtacggttgttgggaaatctgatggtgttgagttcactgttaaagacggttacttctgccctgcacttgctaaggctgtgaaaaccatgaagaaggcagagaaggttcttctgactgttaaaccacaatatggtttcggggagaagggcaagccagcctctggtggtgaagctgcggttcctccaaacgcaacccttgagatcgagctggagttagtttcctggaagacagtttctgaagtgaccgatgacaacaaggtcatcaagaaaatcttgaaagaaggggaaggatatgagcgtcccaatgagggggcggttgtgaaagtgaaactgatagggaaacttggagatggtactgtgttcctaaagaaaggtcacggtgatggtgaagagccctttgagttcaaaacagatgaagagcaagtgatcgatgggcttgataaagctctgttgaagatgaaga

SEQ ID NO: 444 - DNA, 678 bp, Brassica rapa
cccacgcgtccgaaagaaaccaaaagagaaacatctctcaaatggccaccattagagtaccagacgaagttccttccgcagctcaagattccgaaacyctyawccaagctttccgcggatggggaacagacgagaaggcgatcatacgcgtcttaggaaaamgaaacgagagtcaragaaaaagaatcagagagasttacagagagatttacgscaaagatcttattgatgttctcacctctgarctgtctggtgatttcatgaaagctgtggttttatggacttatgttccagcagagagagacgcaaggctwgctaacaacgtcttgaatgggaagaagaaaagcatagagaaacttaagatcatcgtagagatctcttgcacaacttctcctaaccatttgattgctgtgaggaaagcttactgttctctcttcgacttatctcttgaagaacacattgcttcctctgtccctttccctcttgcaaaggtactggtgactttggcaacttcttttagatatgacaaagatatggctgatacagaagtagctactattgaggccggtatgctgcgtgaagcgatcacagcgaagcaactagatcatgatcatgtcctatacatattaggaactcgcagtatctaccagctcagagaaacctttgttgcttacaagc

SEQ ID NO: 445 - DNA, 1849 bp, Brassica rapa
gagatccgatttcacacaatcattagtttatattggcaccgtatccttccttcgtgtctggattttaagtagttacacacaccatcttagagagtttggatatttgattctgcacaatcatggcgaggaagatgctttctgatggagagcttaacaaggccgcagcggctggggaggaagctacaaccgagactcactatgattttgatttgtttgtcatcggtgccgggagcggcggtgttcgtgcggctaggttttctgctaacaatggtgccaaggttggtatttgtgagcttccctttcaccctattagctcggaggagattggaggtgttgggggcacgtgtgttattcgtggttgtgttcccaaaaagattctcgtctatggtgctacttatggtggtgaacttgaggatgctagaaactatgggtgggaaatcaatgggaatgtcgatttcaattggaagaagcttctccaaaagaagactgatgagatattaagactgaacaatatttacaagcggttgttggcgaatgctgctgtgaagttgtatgaaggtgaaggaagaatagttggtcccaacgaagtggaggtcagacaaatcgatggcaccaaaattagttacaccgccaagcacattttgattgccactggcagtcgtgcacagaagcccaacatccctggacatgagctggctattacatctgacgaagctttaagtttggaagaatttcctaagcgtgctatagtgcttggaggagggtacattgctgtggagtttgcatcaatttggcgtggaatgggtgctactgtagatttattcttcagaaaggaacttccactaaggggctttgatgacgagatgagggcacttgtggctagaaatcttgaaggaaggggtatcaatctgcatccacaaacaagtttggctgagttgataaaaacagacgacgggataaaagtaatctcctctcatggggaagaattcgtggcagatgttgtactatttgctactggaaggattcctaataccaagagactgaatttagaagctgttggtgttgaacttgatcaagctggagctgtgaaggttgatgagtactcacgcactaacatacctagcatatgggctgtgggagatgctacaaaccgaattaaccttacacctgttgcgttaatggaggccacctgctttgcgaacactgtctttggtgggaagcctgctaaagcagactacaccaatgtagcttgtgccgtattttgcataccaccactagctgtggtgggtctcagcgaagaagaggctgtagaaaaagcgaccggggatattttggttttcacctctggcttcaaccctatgaagaacaccatttctggacggcaggaaaaatcattaatgaagcttatagttgatgagaagactgataaggttattggagcatccatgtgcggtccagatgcagctgagatcatgcaggggattgcaattgcgctcaagtgtggagcaaccaaagcacagtttgacagcacggttgggatacatccatcttctgcagaggaattcgtgacaatgcgcactgtgaccagacgcattgcctacaaagcgaaacctcaaacgagtctatgaaccgccaaaattaaatagactatttgcattgaacactttagtttggtcggagggtcagaccgaaacatttgtttcgtcatactcatgttcaaataaatgttttgtataagtttttgtttgtttgtttatcaccaaacatgcattatctttggataaaattcacactcttttggtcatatagtgtacttcaatttgtttggtaagttttgtttcaatggtgt

SEQ ID NO: 446 - DNA, 1002 bp, Brassica rapa
aaagatcgacgaacataaacatataacttttcttggtttttaagagttcgaaagacttttagattgttttgtctgctgaagaatcgaagttagaagaaatgggtgttagagaaatggatccgttagcccagttgagcttaccaccgggtttcagattttacccgacagatgaagagcttcttgttcagtatctctgtcggaaagttgcaggctatcatttctctctccaagtcatcggagacatcgatctctacaagttcgatccttgggatttgccaagtaargcyttgtttggggagaaggaatggtayttctttagyccaagagaycgraaatatccraacgggtcaagacccaatagagtwgccgggtcrggttaytggaaggcracgggtaccgrcaaratcatcaygtcggatggycaccgtgtcggrattaaaaaagctctgrttttctacgccgggaaagctccaaaaggcacgaaaacaaactggattatgcacgagtatcgactcatcgagcattctcgtagccatggaagctccaagttggatgattgggtgttatgtcgaatctacaagaaaacatctggatctcagagacaagctgttgcttctccggtacaagcttgccttgaagaccagagcacgaacatgtcgtcgtcgccgtcttcttcgtctcagctcgacgacgttcttgattcgttcccggaratgaaagatcggtctttkgatcttcctcggatgaattcgctcaggacgattctcaacggcaatttcgaatgggctagcttagcaggtcttaatcccatgcctgagctagctccgatgacctacggtttatcgaattacggaggttaccacgcgttccaatcggcggagagcgggtgtaggagttcgcaggtcgatcaggagcagaactcgaccgagttgactcagagtctcgggtacagctcgagcgggttcggactttcgggtcaaatgtacgagtttaggcaatccg

SEQ ID NO: 447 - DNA, 945 bp, Brassica rapa
aagtgaacaccttggcgtcgctgcaacaccagaatctatgtaaattggtgggctatcacgcacgcgatggatctgacacgaggatgctggtgtacgagaggcttgctcttggaagcttggaccgtttgttacatgggagatcagatggtcctccgcttgattggaacactagaatgaagatcgcgttatgcgcggctcaggggctaaccttcttacacgaagaaggcccgtttcaggcaatgtacaatgaattttcaacggctaacatccaagttgacaaagatttcagcgcgaagctatccggatacggctgcgtaggccacgcgcccgagacagagacctcaaacagctcagcactcgcgaatctctcagtagagacgctagagagaggagtcttaacaccgaagagcaacgtgtggagctacggaatagttctcctcgagatgctaacgggacgcaaaaacatggacggctcgtaccctaaagaagaaagaaacttagtgaaatggagcagagcttttctagccgacgactgcagactctctctcataatggaccctcagctcaaaggccggttccccgcgaaagccgcgaggagcatagcggatatagcgcagaggtgtttgcaggcggagccgtcagagcgtccgacgatgaggaacatcgtggatcagctcaagatcatacaggacatgaagtactcgtgcaggttcccgttgcgagaacccgcaccggccgcggtgaggaagcatatggggagatcgagcagtttgaacacgattgtttggactcctggggtggcaggggctgcgccgaggtcgagcttctcgccgtcgcctccggcgagacggccgtctgtttcgcctactaggggacgggggttggcgttccggccggtgtttccggcaagagtgtgttcgtcgttggaggagatgagtagggagg

SEQ ID NO: 448 - DNA, 715 bp, Brassica rapa
gactcctcactttcttcttttttttctatcgttggtatctcagtgtgatctctcatcatacgtttggttgtttctttgatctagatggagacggataagaagaacagccaggagctaggtctgaaacacctagggttcgtgagagttgcggcgatccatgttcttgttagcctctcgagcctttacgactacgcaaaacaaaactctggtcctcttaaaccagcggtggggaaggtggaaggagccgtcaccaccgtcgtcacccctgtctacaataaactcaagaatgttccagataccctcctcctctttctagatcacaaggtgggtgaagcttcggacaagtttgataagcatgctcctccagtggctaagaaagtagtaagtcgagctaatgtgttgatccagacgactacagagaaggctcaacgctttgtgaaagaggctcgtaccggtggtcccagaggtgcttttaactatgctgcagccgagtacaagtgtttccttgtgactaactcggttagagtctgggctaaactcaaccggtttaaaccgattcatgcagtggggaacaaagcttttcccgtggctgcacacgtgtctggtatttacaacgatctggtgacggacatgactcagatgggktaccctgtggttggttatcttcctttagttcctgtcgatgacatcgtcaaggcttatgaaaaggaggaag

SEQ ID NO: 449 - DNA, 1755 bp, Brassica rapa
tgacgcctcttacagtctttggtctttatatataaaagaaaactcgccgctctcatcctcacgtttctcttccttccttccttccttggcccccaaaatctctgaaactttctcgacctctctctctctctctcatcyctccctgaaaagaaccctctctttaatggataaatcgcctctccgatctcattcctcagcgttttcctccagacttttgttgctcttcttctctagttttcgtgcttcgatttctgttgttgtttcccatcgtaattgtcgttgatacgcttttttcgtaaaactcggaagcctctatatcgattcgtcaatagttgatttggatttgatataggaaaccatggggaggaagtctcagcgtaagaacgtccccatggatttgtttgatagtgatgatgatacaagtagtattagctcctcctccaccatgcgttctgagagacccggcatggatgatgttcaggttcacaaagatttgatgctcgatcaatcccttgatgctctctatgagaaaaggacttcgactagagagcaagctttggcctccattgttgatgctttcaacagcgacttgcagcatgagtttgtcgaaaagaagtttgccactttattgcatcagtgcttacactgcaccaagaaagggtccagcaaggagacctctttagcatcacatgttattgggttgctagcattgactgttggacttggggatcaagcacaagagattcttgaagaatccgtcactcctctttctcaggcccttaaatctggtcgtgaagtgttaaaaataacttcgattcttgagtgtttggcagttataacctttgttggtgggaccaatccggagcaaactgagacatctatgcaaataatatggcaaatgattcaccccaaactaggttctaatgttgttgcagccaaaccttcacctgctgtgataactactgttgtctcttcctgggcgttcctgctcacaacagttgaccgatggaccctaagtcccaaactttggcaagagatcgttacttatctctcctcactgttggaaaaagatgaccgatctgtacgtatagctgctggtgaagcgcttgctctgatatttgagtcgggaactctggagaagtttgctgctgaagccaaagagtctgctaataatggatcagtgaaagaaggaagcgtgtctcaggaggcattgattcacatgcatggcctgaaatccaaagtcgttaaccaagttagggacctctctgtagaggcaggtggtaaaggttctgctaagaaagatctcaacacacaacggaatttgttcaaagatcttgttgaatttcttgaggatggatacgcacctgaaacctctacaaaggttggaggggattatttgcagacgacaacgtggtatcagatgatacagttgaattttttgaagcatttccttgggggtggctttatcaagcatatgcaggagaatgagttccttcacgatgtattcagcttcactccaaagaaggttggtgggcgaggttctggcatgtcaagtgaagaaaagaggatgtttaaatcaccaaactcagctctcaacaaagcaaggacgcaattcctgaacaagcagaggatgctagctaagaacatgaacgatgggcattatgcggcgacggtggagaacgaatgatggcttctcactatttgattttaaagctatgcaaacttgcctgctgcctccttgttgacgattgatgt

SEQ ID NO: 450 - DNA, 678 bp, Brassica rapa
agtaacaccgcgcgatcgaaaccaaaaaataaagttgtagcgagaaagaatcaacatggcgagtttactagataaagcaaaagatttcgtggctgataaactcgccggggttcctaaaccggagggtcggttacggacgtcgaccttaaagacgtgaaccgtgactccgtcgagtacttagccaaagtttcagtcaccaatccttacggtcacgcaattccgatctgcgagatcaatttcactattcacagcggtggccgggaaattggaaaggggaagataccggaccctggttcactgaaagcaaaggacatgacggttcttgatgttccgatcgtggtgccgtatagtatactgttcaacttggctcgagacgttggtgcggactgggacattgactatttgctcgaaataggtctcaccattgatcttcctgttgtcggggattttactattccggttaccagcaagggcgaaatcaaactccctacttttaaagactacttctgagtcaactttacgctgttaaaaacaaaacaaaaacaaatatcgtttgtactagtgatcaaatataataactaataagtgtggtttgcctataaaatcattaaatgtctttttcaatgtatgtgtttattcatacagttaataaatcaaagtttaaaactaaaaaaaaaa

SEQ ID NO: 451 - DNA, 549 bp, Hordeum vulgare
ggaagtactcctcccgcgacctcgccgcccacacatccctcaagcccagaaaagagggccagcgaaactcaagaggaggtacaaaagaggaatctcatggacgaacttgaggagcgtgaacgcaagcacttctcatccaaggataagtcctatgttgatgagagggaccggcgaaaaagttcgagcttgctcttagaaggttcaaaacgggatgaggataagatagttccacgtgaaattgatgcagacgactctgacgtggagctcaaaagtgatgatgaaagcgacgatgatgatgatgacgatgacaccgaggcactaatggcagagctcgaaagaattaaaaaagaaagagctgatgacaggtttagaaaggagcgtcaaccagcataaagaagaagcccaagatgaaggaagctgaactgatgcgaggaaacccattgatcaatatgaataactttgggttccttcattgtgaaaagaaggtggaataatattgtggatttcaaaacccaaccccgtggagagactaagaacaccgaaacggtt

SEQ ID NO: 452 - DNA, 2250 bp, Hordeum vulgare
gaggccggggcgaaaagaaccactcaccttcccgcagccgctctctctctctctctcatcacgcacatcacgcacgctggtagctgcagccgctcgctctcatccggtagctagccggccgttggcgccactgctgcgggcgctgctgcttaaaggaggagggtgggagcaatgtcggagcagccattgccgcagccgcggagcagcatgagggaggcgctgcagaaggaggacaaggagaaggcgtcgtccgcggcgcccccggccaaggagaaggcggccgtggccmcgccgcacgtcgscgcgccccccatggccaagaacggcggtggcggggggaagggcggcaacgggggccagccgccggcgccggaggagacgacgcgggagatccaggtggtgcgcgaggcgtaccggcagccggcggcgcccgcgtacgtcatgcccgaggagccccccgccatggtggagctcgtcggctggtacctctacggcttctgctccttcttcatcacccacctgctgctgccggtgctcttcccggccatcgtcacccaggtcgccttcccctcctccgacttcaaccccgaggccaagtacaccgtcaagggcgcctcctgctccgtccacgagatgtccatgtaccagaggctgaccaggtacaccattgccatatctagctcccacatgtcgccactgggctggagcgccctgtcgtgggcgatcggcatcctcctcgtggcgccgctcctcacccaggttgcgcaccaccttgacaggggccagtaccagtcgctcatcctcatcgcggcgacgtcgttcggctcgttcttctgcctgctcactggcttcttcaagacggtctgggtgttcctgttctacatcctcttcatcgctgcgtccatcatcattgctgaggctgtgcacacccgcaacctcgggctgatgatccgtggtcttgctgctcacgactcgggcaaacaccttgtcctccgccgccgcgctgctgccagccagctcagcctctactgcaccgccatcggtggcatcggggcagcactcatggctgcattcatgtaccacatgctgaggcgcactgaccagctcaccggcctctgggtcgtctccatcttcagtggcctcatctggttcatcggcatctgccatggcctcttcacaaacaggcccagcagctcatcacccaccaccgcattcgagccaaacttcttcagcaagctcaggtacagcatgaccattggtcgctacccacaggccattggaagcttggtggcagtgttcctgtcatctttcgccacaatgtgcatcttcaccagcggcactctgtatgccattggcggcgtctgcatcaagccggtcctcgtgctcgcgctgtggatcctctacttcctgttcccgttgatctcgctgccgctgctccacccaatccagatcatcatccgcgctgatgccgtccgcatgcagctgcttgggttcatcatcgccctgttcgtgtccggcgccgggttctacttcaagagccacaggtggagggctgcccacatcatcatcatcgcccttgtccagagcacggccaacggcatcctctactcgttcggccgcattctgctgcttgacgcctcgccgccgggcaaggagggtgcatttgctatctggtacgcctacgtccgctgcatgggcgccatgatcggcttcgccgttgcgtctgctggccctggacgtgcaggagggtcctttgctgctgcgttcctgggcagcttcctcggcatcatcgtgctgatcttcggtaatgtcagcaacatcggggcgctgaaggcagcaggccatctcaaggggatggaggacgagaagaggatcggcgagaagggcgagggcatgagcgccgtcgccgactccggcgagtcgagggggagggtatgatttacatggggttggttggaaagaaagattgctgccattgttgtggtgggttgtgcttgtgagagggtatgatttgttcttctttttctcctgttttttcttgttcatgtttcagtgacactgttaatccggtgctctgccccctttgatgcatgatgattatgatgatgttgacatagtggtagagggagtgtgtgctagctctgttaatgtgttaaattcttttgcttggaagacaattgtaactgaggaagaaatggtcctttgtcatcgcattccccgaagaaataaaacataaaaaaacggaggggg

SEQ ID NO: 453 - DNA, 995 bp, Hordeum vulgare
ctctctctctctctactccgctctgtagcactcgccattttccgaaatctgttagagagagagagagggggagctaggttttccctgcgctcgggcgatccagcaggagcggccaccatgaacatcttcaggaagaaggtcgaccccaaagaggctctcaggacgagcaagcgagagatgtcagtcgccacaagaggagttgagcgagagattggctccctgcaaatggaggagaagaagctggttgctgagatcaagaagactgccaagactggaaatgaggctgcaaccaaaattctagcccggcaactagtcaggcttaggcaacaaatcgtcaatttacaaggtacacgagcgcagatacgcggagtagctactcacacacaggcaatgtatgctggaacttcaatatctgctggaatgaaaggcgcaagcaaagcgatggcagcaatgaataagcaaatggaaccaacgaagcagatgaagcagatgagagaattccagaagcaatcatctcaattggacatgacgcttgagatgatgtctgatgccatcgatgaaacactagataaggatgaggctgaagaggaaacagaagagctcacgaaccaggttctggatgagattggtgttgatgtggcttctcagctgtcttctgcacctaaaggccgtattggagccagtaccaagaaagccgagaacaaccaagcacggaatgcggctccagcgaaaaacgtggcgcctgaacctaatgccgctgaagttgatgatctggaaaggagattggcatctctycgccgcatctgagctgctgctgctgcaagaaagttatatagtgccytawwtatatgtaaatctgkttactggtgccttgtttycaaattctggtaaggtaatattggaaaccaggaaaacaacctagtacaatgtgaaacttgatttaattagaccctgatttttttgttgggtgcaccggcgcgtacttacagattcct

SEQ ID NO: 454 - DNA, 891 bp, Hordeum vulgare
cagcacaagtagtaccatgagcagcactgtaagtagtaatagcagtcctatcgagagagtagattatgattcagactgcctagattatgagatcttgtgggaagacctaacacttggagaacaagtaggtgaaggttcttgcggaacagtgtatcatgctttgtggtatggatcggatgtggcagttaaagtattctccaggcaggaatattcagaagaaatgatacgtaccttcagacaagaggtgtcactgatgaagaagctacgtcatcccaatattatacttttcatgggtgccgttgcttctcaggaacggctttgcattgttacggaatttctcccacgagggagcttgtttcgcttactacgaaaaacaaccggcaagttggatccaagacggcgagttcacatggctatagatatcgcaaggggcatgaattatcttcacagttccagccccaccattgtacatcgtgatctaaaatcatcaaacctgttggttgataagaactggactgtgaaggtggcggacttcggtctttcacgcctcaaaatcgaaacattcctgactaccaaaaccgggaaaggaacaccacagtggatggctccagaagtgctacgtaatgaaccttcaaatgaaaagtctgacgtgtacagctatggagtggtcctatgggagcttgttactcagaagattccttgggatactctcaatacaatgcaggtagtgataggttgcaagatccatctgcgttataatctacttagatacaggaagaagttcaatattttttgcttgatatatcctcccatctccctgtcaatcgggcggcaagattaacactgaggtgtttgtcatagaatgttttgctgttgttgaagaatttcaaa

SEQ ID NO: 455 - DNA, 1561 bp, Hordeum vulgare
tactggatacactccgcgctcccacactccggctataatcatccacccgctcttatctcctcttcctcttcctccctcccccccaccacccccgccatggccacagccgcggcctgcgcgtcctccctcctcgcgccgccctccgcctcgtgcgcggggacggccgcgtccggcgcgctcttccccacctccgtgccctcgttgcgtgcgtacccgcggcttctcctcgcgttccgccgccccgccgccgccgccgtcgccgacccgcagggcgccgccgtgctagaggaggaggacgacgagacgcccgtccagttcgatgacgtcgacgatgattacgaggacggctacggcggccgcggccccgctttcacggcccccacccggccgcgcaccggcaaggccgccctcccgcttaagcgcgaccgtacgaggtctaagagatacctcgagatacagaagctgagggagagcaagaaggagtacgacgtgcccatggccatctcgctcatgaagcaggtcgccaacacccgtttcgtcgagtctgcagaggcgcatttccgtatgaacctcgaccccaagtacaatgaccagcaactccgggccacggtcaatttgcccaaggggacggggcagaccgtgaaaattgcagttctcacccaaggtgagaagatagatgaagcgagggctgcaggagctgatattgttggctcagatgacttgattgaacaaataaaaggaggattcatggagtttgacaaattgattgcatcacctgatatgatgcctaaggttgctagcttgggtaagattctaggaccaagaggattgatgcccaaccccaaagctggcactgtttctccaaacattactcaggctatcgatgagttcaagaaaggtaaagttgaattcagagttgataagacagggattgctcacattccttttggcaaggttaacttccctgaagaagaccttattgcaaacttcatggctgttgttcgctctattgagaggaacaagccatctggtgcaaaagggatatactggaaaacggcatatgtatgctcatcaatgggaccttcaatcaagctaaacataaaagaaatgctcgactatggcgcagattcgtctaactagatgtcaccacgagcaccaattaagtcactgggcatttgcttaccaatttcacaggcttgaccatccatcccttgtgataaatacactgagaaacacgactgtgggggaagactgggagtgcttaggtacagttttttttagtttcacgggcatccaacatcagcacttaaacaatgccctgatcgacaaacaggcgagacgtttgtatttatgagcggattatgcatgcacttatagatgtccttttgcctgatatttgttgtaatgttcatcattatgtcaatagtcatccttgagcttcagccaaatatcatgtcctcacccgacattattgttaagttgttgtggttcttgaaccatactttttccgaactattgtaggagtacaacttgtgtaaaggaagagtgaattgtagaaaac

SEQ ID NO: 456 - DNA, 828 bp, Hordeum vulgare
ctcccacgtggaagtttgtttcggttgctccgaactaacattggcaagctcgatccaagacggagagttaacatggctatcgacattgcaaggggcatgaactatcttcacaattccacccccactgttgtgcaccgtgatttgaaatcgccaaacctgctggttgataagaattggactgtaaaagttgcggactttggtctttcacgtctgaaactcgaaacttttctgacaacaaaaactggaaagggaacaccgcagtggatggctcccgaggtgctgcggagtgaaccttcaaatgaaaagtctgatgtattcagctatggagtagtcctgtgggagcttgttactcagaagattccctgggatactctcaatacagtgcaggttgtcggagccgtgggtttcatggatgacagacttgaaattccgagggacacggatcctcagttggcatcgatgatccagagttgttgggacagtgacccgcaatgtcggccttcgttccaagaacttcttgagaggcttcaggagctgcaaaagcagtacactattcaagtgcagacggagccaaaaaaacgggtgggaaaggtgccggaaakatgagcmccaaasatagctagcttgtgttytaatggaagatggattatgcagaccccaccttcggcgtgatttatccgacccgagcccggaagggttcgagaatgttttctatgttagagcatctccgacaacttgtgtatatgtttatatagacaatggtctaaaatgattccttcatatacacaaacagttctttaacagattgcctatatacagattatctat

SEQ ID NO: 457 - DNA, 817 bp, Ocimum basilicum
caccaaatctcttcaattttggtatattccaagtgaaatctgttggcggcgattttagtgatctcaaatctccgcgtttgagctggagtgaagacttcccagcgaaattctccgaatccgattactagggttttgtttgttcctcaaagtcctcgattttggcaatattatctgtaattctctgctgtctgtgatattcggagaattctggtttgtgaatttgattacaagtgtagagagagtctcgatttttgtataaataaaaaagggtaggagaagatgagttttcaagatatagaagcgggtcgcagcaacgggtcgcggaggggctacgccaacgggaagcaggatccgacgcaggcggtggtgtccgggatttttcagatcaacacggcggtttccacgttccagcgcctggttaataccctgggtacccccaaggacacgccggagctccgggagaagctacgtaaaactcggctacatattgggcagctggtgaaggatacctcagataaacttaagcaagctagtgaaatagaccatcatgctgaagtcagtgcaagcaagaaaataacggatgccaaacttgcaaaagactttcaagctgtactgaaggagtttcagaaggcacaacggcttgcagctgagagagaaactgcttatactccttttgttcctcaagcggttcttccgtctagctactctgctggtgacatggatgtaagtgcagataaggccccagaacagcgactgcttttggaatctaaaaggcaggaggttttgctgctggacaatgaaatcgcttttaatgagg

SEQ ID NO: 458 - DNA, 1844 bp, Phaseolus vulgaris
ttgggttttcttcattcccaaacctacttactcctattacgaagacgacgcagatttagtttaaattgttcgattgcgatggctaggaagatgcttatcgacggtgaagctgaattggttccaggtgttgaacaagggatgaattttgacttcgacttgtttattattggggctggaagtggtggcgttcgtgccgctagattttcatccaattacggagctaaggtggggatttgtgagcttccgtttcataccattagctcagaaacaattggaggagttggtggaacgtgtgttattcgtggttgtgttcccaaaaagattttggtctatggagcatcttatggaggtgaactcgaggatgccaggaattatgggtgggaattgagtgagaaagttgacttcaattggaagaagctcttgcaaaagaagacagatgaaataaacagattaaatggaatttacaagaggttgttatccaatgcgggggctaaattatttgaaggcgagggaaagatagttggtccaaatgaggttgaggtgacacaattggatggcacaaaactgtcctattctgctaagcacatattgattgcaactggcagcagggctcaacgtccaaatattccaggacaggagttgggtataacatctgacgaggcgctaagtatagaggatcttcctaaaagagtggtgattcttggaggaggttatattgctgtggaatttgcatctatatggcgtgggatgggttctgaagttcatttagttttcagaaaggaacttctgctaagaggttttgatgatgaaatgagaactgtagttgcaagaaatcttgaaggcaggggaattaatttacaccccaggaccaatttgacacagttgatcagaacagaaaatggcattaaagttattacagatcatggcgaagagctgattgcggatgttgtactatttgccactgggagggctcctaattctaagaggttgaatctagaagctgtaggtgttgagcttgacaaagctggagcaataaaggtggatgagtattcacgcacaagcatacctactatatgggctgtgggtgatgtcacaaacagaatgaatcttacacctgtggccctgatggaagcatcatgctttgctaaaacagtatttaatgggcaaacaagcaagccagactacagtaatattgcatgtgcagtgtttagcattccaccactttctgtagttggtctcagtgaggaggaggcaatagagcaaaccaaaggtgatctgttgatttttacatcaagcttcaatcctatgaaaaataccaccaaagggcgacaagaaaaaactgaaagaaaaactgttatgaagcttattgttgaagctgagacagataaggttctcggagcctcgatgtgtggacctgatgcacctgaaattatacagggtattgctattgcattgaagtgtggagctaccaaggcacagtttgatagcacggttggcatatacccatcggcttcagaagaatttgtaaccatgaggacggtgacacgaacggtaactggaaatggcaaacccaagaccaatttgtaaaatgtcttcaatgaaaataatttctgtttgatggtagtctaaacctgcatattacttcctttagtgaccttcccacaactattcatctttaaaacatatgtttttcctctctcaataaattgggctttttatttttcaaatatcattctatttgrcattccatagtggaaacagtttggttcattatgtatgtaagaatgagttataaaaagtatttttgagttgaatatgttcttaatcccttgaatttgagttca

SEQ ID NO: 459 - DNA, 1439 bp, Phaseolus vulgaris
ttcctttccccggcgtcagagaaagcgatggaagaagatttcaacattcccggcggcgaggaaatggatctcggcgaagtcaaggtcggagaggagagggagatcggatccaacggcctgaagaagaagctccttaaggaaggtcaaggctgggaaacccccgaagtcggcgacgaagttaaagttcattacactgggactttgctcgacggaacgaagttcgattcgaaccgtgacagggattctcccttcagcttcacgctcggtcaagggcaggtaattaaaggatgggatgaaggtattaaaacaatgaagaaaggtgaaaatgccatttttaccatccctcctgagctagcatatggtgaatctggttcccctccaacgatacctcctaatgctacactccaatttgacgttgagcttctttcatggactagtgtaaaggacatatgcaaggatggtggyatatttaaaaagatacttaccgagggagagaaatgggagaaccctaaggatcctgatgaagtattggttaagtatgaagctcatctggaagatggaaaactggtaggaaagtctgatggagtggagttcacagtcagagagggtcattattgtccygcattgtcaaaggctgttaaaaccatgaagaagggagagaaagtggttttgacagttaagccacaatatggatttggtgagaaggggaagccagcacaaggtgaggaaggtgctgttccaccaaatgcatcattggagattactcttgaattagtttcatggaaaactgtttcggaagtaactgatgataagaaggtcataaagaagattgtcaaggaaggggaaggatatgagcgtccaaatgagggggccagcgtgaaggtgaaactaattggtaagcttcaagatggtactgcctttttgagtaagggccacgatggagaagagaagctgtttgaattcaaaaccgatgaggaacaagttgttgatggacttgatagagctgtattgactatgaagaagggcgaggttgcattgttgaccattgaacctgagtatgcttttggttcatcagagtctcagcaggacttggcagtggttccttctaactcgactgtgtattttgaagttgagctagtgtcatttgagaaagagaaagagtcctgggatctgaataccgaagagaaacttgaagctgccggtaagaagaaagaagaaggaaatgtgttgtttaaagctggtaaatatgtaagagcatccaaaagatatgaaaaggctgtgaaacacatagaatatgattcttcctttggcgaggaggagaaaaagctggcgaagaccttgaaggttgcctgcaatctgaacaatgctgcttgcaagttgaagttaaaagactataaagaagcagagaaattgtctaccaaggtgttagaccttgagag

SEQ ID NO: 460 - DNA, 1153 bp, Phaseolus vulgaris
caacgaaaccattctcccaaaaccggcgaaggaagtcggtgacatcaaattcgatccctaaaacgtgaaatccgatgactaccgccgctcgacccacatgggcacctgcaaaaggtggcaacgaacaaggtggtactcgaatcttcggtccctcacagaagtactcttctcgggacatcgcatcgcacaccactctcaagcctaggaaagatgggcaggacacacaggatgagttaaagagaaggaacctgcgtgacgaactggaagatcgggaacggaggcatttctcatcaaaaaataaatcttacgatgacagggatcatggaaagggtagtcatctgtttttggaaggatcaaagagagaaattgaagaccacattgttcctcgtagtgttgatgcagatgattctgatgttgaagtcaaaagtgatgacgagagcgatgacgatgatgatgatgaggatgacactgaagcattgctagccgagcttgaacaaataaagaaggaaagagcagaggaaaagctacgcaaggagcgacaacaacaggaggaagagctcaaagtgaaggaggcagagcttctgcgtggaaacccactgctaaataatccaacttctttcaatgtgaaaagaaggtgggatgatgatgtggtgttcaagaaccaagcccgcggtgaaaccaaaatagctaagcgattcatcaatgataccatcaggaatgatttccataggaaattcctgcataaatacatgaagtaagtccttgtgcccagaactcggttgtttggacacaacagaactagttgatttgcaggttgtatctaaatgtatgattcaacattgatggatatattgtttatctttaaacgtatttcatcatgctactcgtagttgctgcaacttcatgtttgttaatgttagctggtttaaagagtcagaccattaaatattatgcagtgaggtctctctttctcaccctctactattcgttgttgtgaattctattcactagttggaccaaccacttaataatagcattgtacatggacacaaccctgcatatctgttatcgacactgcaaggaaagtatgtcagccactcgtttgtttggcagttaatgtaatgttttaagattttccttattagatggatct

SEQ ID NO: 461 - DNA, 941 bp, Phaseolus vulgaris
ttttcccagatcccggtaaacgccaccttcgccttttccctccctttctccggaaaattcctccgattttctcgagaaagtgaaacggaattatgagctttcaggacatcgaggctggccggcccttcggttcccggcgtggcttggccaacggcaagcaggaccccacgcaggccgtggctgccggaatattccagatcaacaccgccgtctccaccttccagagacttgtcaacaccctcggaacccccaaagacacccccgacctccgcgagaagctccacaagacaagactacatattgggcaattggtgaaggatacatctgctaaacttaagcaagccagtgacattgatcaccatgctgaagttaatgcaagcaagaagatcgcagatgctaaacttgcgaaagattttcaagcagtgttgaaagagtttcagaaggcacagcgccttgcagttgaaagggaaacagcgtacactccttttgttccccaagcaatccttccttccagctatactgctggtgaattaaatgttggttctgataaatcaccggaagagcgtgctttacttgtggaatcaaggaggcaggaggttttgttcttagataatgagattgcctttaatgaggccatcattgaagaaagggaccaaggcattcaagaaatacagcagcaaattggtgaagttaacgagatcttcaaagatcttgctgtgcttgtccatgagcaaggaaccatgattgatgatattggctccaacattgagaattcccatgcagcaactgcacaagcaaaatctcaacttttaaaagcttcaaagacccaaagatcaaattcctctttgacatgcttgcttttggtgatttttgggattgtgcttctgatcgtgatcatagttcttgctgcttagacaaatattgtctcaattccattatgg

SEQ ID NO: 462 - DNA, 616 bp, Beta vulgaris
cttcaaccctcctcaattatcgctgcttttccctgaattctgaaaatttctcagatttccagatcctaaatttccaattttaatcacccaaaaaaaaagttgaattgcgaggaagaagaagaagaaaagagatgagctttcaagatctggaagcgggtcgtcggccactggcttccagacgtgatttaataaatgtaaaacaacaacaagacccaactcaggccattgcttctggaatcttccagattaacacatctgtttcatcttttcaacgtcttgttaatacccttggtacacccaaagatacccctcagcttcgtgaaaaactccacaagacaaggttacatattgggcaattggtaaaggatacctcagcaaaactcaagcaagcaagtgagacagatcatgaatataatgtcagtgcaagcaagaagattgctgatgcgaaacttgcaaaagatttccaagcagttttgaaggagttccagaaagctcaacgtcttgcagcagagagggaaacagcatattctccttttgttcctcaggctgttcttccttctagttacacagcaagtgagattgacgtgagttcagataagacaccggagcagcgagc

SEQ ID NO: 463 - DNA, 542 bp, Beta vulgaris
gatttacatacatatattcaacacaagggaaaatattaatttacaatcgtaaaattttagtggaaaaattatcgttgggtgaagaaaaatgggagttcaagataaagatccacttgctcaattgagtttaccacctggtttcagattttaccctactgatgaagaacttttagttcaatatttgtgtcgaaaagttgcgggtcatcaattttctcttcaaattattgctgaaattgatctttataagtttgatccatgggttttacctagtaaggcgatgtttggagaaaaagaatggtatttctttagcccgagagaccgaaaatacccgaacgggtcccgacccaatagagtagccgggtctgggtattggaaagctactggaactgataagataattacaacacaaggaagaaaagttgggattaaaaaagctcttgtgttttatattggtaaagcacctaagggtacaaaaactaattggattatgcatgaatatcgactcactgaaccaactcgcaaatccggtagctccaagttgg

SEQ ID NO: 464 - DNA, 478 bp, Beta vulgaris
tgcgttttctctctcttcgcttaaaatctgcaattctccaatttttttctctgaaaatggcggcgactgaaactaagccagctactgaagaagctaagatggatctgtttgaagacgatgatgaatttgaggagtttgaaatcgatctcgagtgggacagcaaggaagaaggaaaggaggtaactcagcagtgggaagacgattgggatgatgacgatgtcaatgatgacttctcactacaactaaggagggaacttgagagtaatgctgttgagaagaaatgaaccatctgtggttggtggattctggttattgtcaactgaartaycagcttcaagttttcgggtgctttatatcctgtggtagrtttctaaatatctgagactttwagttgctggtggtgtgaaattctgttgatggggatgtagtggagaaaatagtggtcatgaatcatgatgataacgttgtagttgttatc

SEQ ID NO: 465 - DNA, 634 bp, Beta vulgaris
ttacaatttacaattcgctctttctctctctagattcatcgaaatactcaaattttaggattctcagcatcaaaattagaggaacagataacttcgatcttccgaaatattgaagatattctttaggtggtgaagtagaatgacgacagcagctagacctacatgggcacctgcaaagggtggtaatgagcaaggtggtacaaggatttttggtccatctcaaaagtattcttccagggatcttgctgctcatacaaacctaaagccgaggagagacggtcaggacacccaggatgaagttcagaagaggaaccttcgtgatgagctagaagatcgtgagcgaaggcacttttcatcgaaagacaaaccttatggtgaggatagagaccgaagaaagggaggccatcttctcctggaagggtcaaaaagggatgctgaagaccgtattgctcctagaaatgtagatgctgatgattctgatgtggacgataaaagcgatgatgaaagtgatgatgaggatgatgatgatgagggtgacactgaagcgcttttagcagcgcttgaacaataaggaaggaaagggactgaggacagttgagaatggatcgacacagcaagaggaagaattgaaaac

SEQ ID NO: 466 - DNA, 1296 bp, Brachypodium distachyon
cagcacaagtagtactatgagcagcactgtaagtagtaccagcagtcctatcgagcgagcagattatgaagcagactgcctagattatgatatcttgtgggaagacctagctcttggagaacaagtaggtcatggttcttgtggaacagtatatcatgctttgtggtatggctcggatgtggcagtcaaagtattctccaagcaggattactcagaagaaatgatacagacctttagacaagaggtgtcactgatgaaaaaattacgccaccccaatataatactcttcatgggtgctgttgcgtctcagcaacgactttgtattgttacagaatatcttccacgagggagcttattttccttgcttcgaaggaccactggcaagctggatccaagacggcgaattcacatggctatagacattgcaaggggcatgaattatcttcacaattgcagcccaactattgttcatcgtgatctaaaatcatcaaacctgttggttgataagaactggaatgtaaaggttgcggactttggtctttcacgcctaaaagtcgaaacatttctgtcaacaaaaactgggaaaggaacaccacagtggatggccccagaggtgttacgtaatgaaccttcaaatgaaaagtctgacgtgtacagcttcggagtggtcctgtgggagctcgttactgagaagataccttgggataatctcaatataatgcaggttattggagcggtgggattcatggaccagagactggaaattcccagcggcatggatcctcaatgggcttcgatgatcgagagttgttgggacagtgatccacaacgccgcccttcgttccaagaactcctggagaggctccgggggatgcaaaagcagtacgccctgcagcggaaaatggctggaaaaggcgctgagaaggtgatcgatgaagattgctagctagctccaggccccaattgggatggacattgtagtcgccattgcgagcacagatagccagggtccaagtcttggattttcgatgtgtcctccatggttacctccgggaggaactatagccagaggagtgccgtggtgattcatcctcggtttctcgaatcgcaaacctgaagcttggaaatgcagtttgtcttcagacaagaagactggaggacagtcgaggcgttagttgatcagttggtctctgactagtggcagattgtgttgtatatggaaagttgcatacatttaaagttagctagggaaactaaattgcaagattacagaatacaccagattgaaaatcaaat

SEQ ID NO: 467 - DNA, 830 bp, Brachypodium distachyon
ccccaacccaatcctcctcaccagatctcaagctcagcatcatcaaccagcagcagcgatggggtcggcgagcagggcggtctcctgcctctgctgcccgtgcaagtgcctggcgtgcgggctcttcagctgcctctgcagcatcctcgtctcgctcctcgtcaccgcgggggtcctcgccctcatcctttacttcatcttccgcccccacatgatcgccgccaccgtcgactccgccgccctcacccagttcgccctcgccccgaactccgccctcagctacaacctcacggtcgccatgaccgtccgcaaccccaacaagcgggtcggcctctactacgacggcgtcgaggccctggcgctcttcgagggccagcggttcgggtacgcgccgctggattcattctcccagggcaccgacgcggtcacggagctcaagcccgggttccatggccagcagcctgtccagggggacgtcacggccgccaacttcagggcgcagcagtcggccggcgcgtttgatgtcgaggtcaagctcaacgccaagctgagagtcaaggtgtgggcgttcaaggtgcccgggccccgggccaggatcagctgcccgatctcggttccggctcctgggaacgcctccgcgccggcgttccagcccaccggatgcaaagtctggttctgatccgtttgactggcgttgttcattggttcatctgtttaatattactcctgctactctactacggagtagtagtattgttattggtagcgtatatgaattcttttgtatcgatctgtagttgattcggcggtattctactggagtatgtatt

SEQ ID NO: 468 - DNA, 949 bp, Brachypodium distachyon
ccgcgttgtctcgtctcgattctcttctcgctctcgaacaccccaacgagaggaccaatctcctagggtttcggctgcttccgaccgagagaggagatgacgacggcggcgcggccgacgtgggcgccggccaagggcgggaacgagcagggcggcacgcgcatcttcgggccctccgggaagtactcctcccgcgacctcgccgcccacacctccctcaagcccagaaaagagggacagcaaactcaagaggagttacagaagaggaacctcagggatgagcttgaggagcgtgaacgcaagcactactcgtccaaggataagtcctatgttgaagacagagaccggcgaaaaagttcgagcttgctcctagaaggttctaaacgagatgctgaggataagatagttgcacgagaaatcgatgcagatgactctgacatggagcccaaaagtgatgatgaaagtgatgaagatgatgacgatgatgacactgaggctctaatggcagagctcgagaggattaaaaaggaaagagccgaggacaagcttagaaaggagcgtcagcaagcagaagaagaggccaagatgaaggaggctgagctcatgcgaggaaacccactaatcaatatgaacaactctggctccttcaacgtaaagagaaggtgggatgatgatgttgtattcaagaaccaggctcgtggagagatcaagacgccaaaacggttcatcaacgacaccatcaggagtgatttccaccgcaagtttctgcataggtacatgaaatgatgctgtagtatgatttatgttgcctggctgggtaccttctggcctcctggaaagacctgtgatgtttctgtactccaaagatcaatttgtatgacattactgtaacatatgctctatctggatggtgatatttttaccctcttcgtaagagtaaagaaacaac

SEQ ID NO: 469 - DNA, 912 bp, Brachypodium distachyon
ggatcggcttggtttggtagtcacttcccttcgccaccacgttgatatcctctctgctcgatcgatcttcactagccaccagcgatggcgccccggttcctggcgtgcttcggcagcaggggcggcagcgcgacggcctctgcgccggacaaccctgcggagcaggccgatgatcagcagcagcagctgcccccggggccggtgctggtggagctcttctcctcgcaggggtgcggggcgtcacccgaggcggacgccgtggcggcgcggctggcgcaggacgcggcggaggagggcggcgccggcgagcgcgcggtggtcgtgctcgggttccacgtggactactgggactaccgcggctggaaggacccgttcgcgtccagcgcctggacggttcggcagaaggcctacgtggaggcgctccaactcgacacgctcttcaccccgcaggtcgtcgtccagggccgcgcccactgcgtcggcaccgagcaggacaagctcgcccaggccgtccgcgacgcgcctcgttacccatcccccgccatgaaggtgacgttccagaggccgaacccgggcacgctgcaggcgacgttcaagggcgcgctcagggcgcgcgtggacggcggcgacgggagcgtgctggtggcgctgtacgagagcggcgtggtcacggactgcgggcgcggcgagaacaaggggaagtcgctgctcaacgaccacgtggtgcgccggctggagaaggtggccgcggtgcgggacggcgcctccgcgaagaagaccgtgtccgggtccgtccagttcccgctgtgggacggcttccgggccaccaagtgcggcctcgtcctcttcgtccagaacgccaagctgcacgtgctcggcgtccagcacttcgacctgcccgacaacgtctga

SEQ ID NO: 470 - DNA, 219 bp, Brachypodium distachyon
gcggcagaggcggccaagatggacctgctcgaggatgacgacgagttcgaggagtttgaggtcgaccaagagtgggatgacaaggaagatggggatgaagcagttcagcaatgggagaatgactgggacgatgatgatgtcaatgatgacttctccttgcagctcaggaaagagctggagagctactcgtcaaagaactaggatttgcggtcttgcatt

SEQ ID NO: 471 - DNA, 536 bp, Brachypodium distachyon
aatccggatctctgtactcaccctctgatctgctcggccgcgtcgcaggtactagacaccagcaccagcgctgatggcggcggccccggcggacgcgaaagctgaggcggccaagatggacctcctcgaggacgacgacgagttcgaggagttcgagatcgaccaagaatgggatgacaaagaagacggcaatgaagtggtccagcaatgggaggacgattgggacgatgacgatgtgaacgatgatttctcgctgcagctgaggaaagagctggaggaaggcagtgctcagaagagctgaactacttccctagcaatgccaaactgttgctatcttcgtttaggcactgtgtgcgtctgcaagcagtctaatttgtggaacagtggcagtttgtgcatggcgtagtactattcggaagtttgcatggatatacagtttgtgtatggcgtacccgtaagatcggccagctattgaacttggatatgctcctttcaatccaatgtggaacatttggtgacgctggtagaattctctt

SEQ ID NO: 472 - DNA, 697 bp, Brachypodium distachyon
cgactaatagtgtaagcaaagcataagtttagtgatcatcacagcaaataattaagcagagggatcgatcgagatgacaatgaggccggtcatccttgttgccctggccgcggtgctgactgctggtgtcatgcttgaagggggtgccgaggccgccggggagtgcgggaggtcctccccggaccggatggcgctgcgaatggcgccgtgcatctcggcggcggacgacccgaactccgcacctacgagtagctgctgctcggctgtgcacaccatcggcaagagccccagttgcctgtgcgccgtcatgctctccaacacggccaacatggccggaatcaagccggaggtcgcgatcaccattcccaaacgctgcaacatggccgaccgccccattggctacaagtgcggagattacacgctgccctgataagctaagctatgcatgctacggatcaagatgaatatatggcgccgtggaaggcttaataatctgtgtggcaataagcgagtcctgcatacgggtaccgctcacgtcgggcgggctgtcgtacgtagtaacatcgttacgcgcgtgtgtgcttgtgggaatatgttcccaaccgtatatcatgtttcgtttgtgctttttcgaaaaaaaaaatgtttcgtttgtgctaaataagagtgaacgtctctttgttctataatcatgcgt

SEQ ID NO: 473 - DNA, 371 bp, Brachypodium distachyon
gctgaggtagtaatgtttgatggttacatcattgtctacaagttcatccaagatctacacttctttgtaaccggaggagatgaggagaatgagctcattttagcgtcagttcttcaggggttttctgatgctgttggcctacttctcagaaacaatgtagacaaaaggactgcactcgaaaatcttgatctcatctttttatgccttgatgaagttgttgatggagggattgttcttgaaacagatgcaaatctgatagctgagaaggtatcaggtcatggattggaaggagctggatcattcactgagcagacaataagccaagccctggcgacagcaagagagcactttgcaaggtcacttctcaagta

SEQ ID NO: 474 - DNA, 1678 bp, Brachypodium distachyon
ttccaaaccaaacgggacaatcaccacgacctcgagccgctccgtctccgttcctccgcttgtagtccactaccctccatccaagaccgaaggcgccggatggcagcggcatccaccacagacggcggcgtcggggccatcctcactgccggtgagagggactacctcgtccgcaactccggcgagcaggtgaagatcagcagcattgaggcaggcactgtggccctctacttctcggcctcatggtgcccgccatgcaggcggttcacaccgaagcttatagaggcatacaaagagcttgcctcacagggcaagagctttgaggtggtctttgtttcaggtgatcaggatgaggaagcattcaatgcctactttgctaagatgccgtggttggcagtccccttcactgactctgaaggtcgtaaaagccttgatgagcggtttcaggtccgcggtattccacaccttgtcatccttgatgcaaaaactggtaaagtttgtactgaagatggagtcgagtttgtgagtgagtatggaatagatgcttatccttttacacctgagaggatcaatgaattgaaggaacaagaaaaggcagctaaggataatcaaactattcatagtgtgcttagtgcaccgactcgtgactacttaatttcaaacaagggggacaaggtacccatctctgatcttgaggggaaatatgttggtttgtgctttgtggtgagtggttatggtccagttgaggaatttaccacagtgcttgccaagatatatgggaaactcaaagaagtggggaaaaagtttgaagttgtagctgtatccatggacaacgatgaggcatcgttcaatgagagttttcaaaacatgccttggctcgccattcctcagggtgacaagatgtgtcagaagctggtcagttactttgagcttaatgatcttcctacacttgtgctgattggtcctgatggaaagacactgaatagcaatattgcggacataattgaagagaatggtgtggagtcatgggaggggttccccttcaatgcagagaagctggaaattcttgctgagaaggcaagggctaaagcagagtcacagactttgcagtcccttctggtcactggtgatttagactttgtcatcgggaaagatggagcaaaggttcctgtgtcacaacttgttgggaagactgtcctcctttacttttcagctcaatggtgtggaccatgccgagccttcctgcctacacttgtcgatgtatacaacaagatcaaggaaaagaatagtgactttgagattgtcttcatctctagcgacagggaccagagctccttcgatgacttcttctctggcatgccatggcttgcccttcccttggaagatgaaaggaaggcgtacttaaagaagatgttcaaaatccgtgggatcccttctcttgttgccatcggtcccagtgggaagacggtcaacacagatgcgaaagccccacttgcagtccatggtgccgacgcatttccattcactgaggagaagatccaggagctggagaagaatatcgatgagatggcaaaagggtggcctgagaagctgaagcatgagctgcatgaggagcatgagctcgttctgacacgccaccgcaggccatttggctgtgacggttgtgatgaaatgggca

SEQ ID NO: 475 - DNA, 804 bp, Brachypodium distachyon
gcacaagacaggcggaaaggaagcacctctctctactaccaaatcccaaatcttcgagacaagagagagacagagaggttttccctgtgctcgggcgatccagcagccatgaatatcttcaagaagaaggttgaccccaaagaagctctcaggacaagcaagagagagatgtcagtggccacaagaggagttgagcgagagattggctccctgcaaatggaggagaagaagctggttgccgagatcaagaagactgctaagacaggaaatgaggcagcaaccaaaattctagctcggcaacttgtcaggcttaggcaacaaattgtcaatttacaaggaacacgggcacagatacgtggagtagctactcatacacaggccatgtatgcgggcacttcaatatctgctggaatgaaaggtgcaagcaaagcaatggcagcgatgaataagcaaatggaaccagcaaaacagatgaaggtcatgagagaattccagaagcaatcaactcagttggacatgacgcttgagatgatgtctgatgccatagatgaaacactggataaagacgaggctgaagaggaaacagaagagctcacgaaccaggttctggatgagattggagttgatgtggcttcgcagctgtcttccgctcctaaggggcgtattgggtccagtaacaagaaagccgagagtaaccaagcacggaatgcggctccagcgagaaacgcggcacctgaatccaatgctgctgaagttgacgacctggagaagagactggcatctcttcgccgcatctgagctgct

SEQ ID NO: 476 - DNA, 2054 bp, Brachypodium distachyon
gggaactgcacctctggaagtgggagctcctcgtgtttgtgctaatatgcggtcgtctcgtctctggctgggttatccggattgctgtcttctgtgtggaacgcaattttgtgctgcggaagcgcgtgctctactttgtgtatggcgtgcgcggcgccgtgcagaactctctttggctcggcctggttcttgcctcttggcacttcttgtttgatgagaacgtccaacgggagacaaacacgccggtgctgccctatgtgaccaaggtacttttctgcctcctcgtcgccacactcatccgccttgtcaagacgctgctgctcaaggtgctggcctcgtccttccatgtctccacctactttgatcggatccaagaggcattgttcaaccaatatgtcattgagacactctctgggccgcaactagtcgacgaagactacgtgcttgctgaggtgtgcgagctccaacgtgcaggggcagtcatccccaaagagctccgtgccgcaatgccgaccaagaacctattgccgcaaaggagcattcggatatctggtctaatttccaagggaggtagcaagcagctgtccaaggagaaaaaagagcgtgagattgatgaagggatcaccattgacaagctccataggctcaatcagaaaaatgtgtcagcctggaacatgaagaggctgatgaagatcgttcggtttgggacactcacgacaatggatgagcagatacagcaggctacaggagagggtgatgagtcagcgacacagatccgcagtgaatatgaggcacagattgctgccaagaaaatatttaataatgtagcaaagccaggatccaagtacatatacttggcagacttgatgcgcttcatgaggcaggaggaagccatcaaagctatgcatctttttgaaggagcacaggagcactgtagggtcagcaagaggtctctcaagaactgggtggtgactgcatttagagagcgcaaagctcttgccttaacacttaatgatacaaaaactgcagttaacaagctcaaccagatgaccaatattatcgttggagttatcgtgtttgctctctggctacttattcttggcatagcgacaacacatttctttgtcttcctgagctcacagcttcttgtggcagtttttgtatttgggaatactatgaagacaatttttgaggcaattattttcttattcgtgatgcatccttttgatgtcggtgaccgctgtgaaattgaagaagttcagcttgttgtagaggaaatgaatatcatgacaacagtctttcttcgttatgataacctgaagatctattatccaaacagtgtgctggccaccaaaccgattatgaatttctacaggagtccagatatgggagaaggaattgatttctctattcatgttgccacaccggttgaaaaactggccctgatgaaggaaagaatactacgatacatcgacaacaagaaggagcattggtacccgggcgcgatggttgtcctccgagatgtagatgacaccaacaagctgaaagtatccatatggctccggcacacactcaacttccaggacatggggatgaggttcgtgaggagggagctggtgctgcaagagatgatcaaagtcttgaaggatcttgacatcgagtaccggatgttgccgcttgacgtgaacgtccggaacgcgccacctcttcaatcgacaaggatgccaacaacgtggaattattcctgaagcagcaaacatgcgggccatcctgttatggtaccacagttgcatttcctatttccagtggggagaactgcgagagccttgtagcaattagcagcagcaaggagatagagagagagataacgtgcccgcggcgatcagtttctgcggtctgtaactagtgtgtcttggtacatttggtgataggaatacatatggtggccattcaaaatggtgcaagcagtgagttttgtaggcaagcctgcggctgccctgaaatctttttgttgaaggcacgctgcttctcccagtgctgaaacttctgttctg

SEQ ID NO: 477 - DNA, 753 bp, Brachypodium distachyon
cacggcgagaacaggacacacgcaaggacggaagcgcagagctcttcgcctcttctgctcgcgacgacgacgacgatgagccccccccgcgtcctcctcctcctcgccgtcgtagcgacggcggcgtgcttcggcgccgcggtggcggatcagcccggatccggcgaggggtacacgatcgccggccgcgtcaagatcgacgcggaaagggctttggtcttccagccaagacatcaaacactaaagtgatacttaatggtggtcagaaggttacatttgccaggccagatggctactttgctttgtatcaatgtgccagccggaactcatctgattgaagtctcgtcacttggctactttttttcaccagttcgagtggacatcagtgccaggaatcctgggcatattcaagcagcattgactgaaaacagaagagttctaaatgagctcgttttggaacctctgaaagaagagcagtactatgagataagggaacctttcaacgtaatgtcccttcttaagagccccatgggtttaatggtcggttttatggtcctaatggtttttgttatgcccaagatgatggagaacatagatcctgaggagataaagcaagctcaagaacagatgcggaactcacctgttccatccttttctggtttactagcaagagcaaacagctagatgtaggacacgtggacaacatgtgatttaagtctattttgtgacaaatatcagtactaaactgcttca

SEQ ID NO: 478 - DNA, 913 bp, Brachypodium distachyon
ctcgcagcagccaccggtacctaccagccttatctcttctcgaagctcagcgcctcgatcagcctagcctagggtatgaagatccagtgcgactcgtgcggggtcgcggcggcgacggtggtgtgctgcgccgacgaggcggcgctgtgcgggcgctgcgacgtcgaggtccacgcagccaacaggctggccagcaagcaccagaggcttcccctggacgcgctcggcgccggcaagctcccgcgctgcgacgtgtgccaggagaaggcggccttcatcttctgcgtcgaggacagggcgctcttctgccgcgactgcgacgagcccatccacgtccccgggacgctctccgggaaccaccagcgctacctcgccaccggcatccgcgtcggcttcggcgggcccgtctccgcctgcgccgatgccgaccacggcgccagccacgatgccgaccaccacgccccgcccatggcccccgcggccgagcgcccgccggcccaggcccagcaggttccctcgccgccgcagttcctgccgcagggctgggccgtcgacgagctcctgcagttctccgactacgagtccagcgataagctgcacaaggaatcgcctctcgggttcaaggagctggagtggttcaccgccgacatggagctgttccaagaccagacgcccaagggcggcaggacggcgatagaggtccccgagttcctcaactcgcaggcggcggacgacgctgcctactacaggccgagcaggggcgccgccaccgccgtcgtgcgccagagcaagaaggcccggatcgagatccctgacgacgaggatttcttcattgttcctgatcttggctaaacaacactcctaggagttgtacttcctcttgtaattttgcagtgttgttgtatacagagag

SEQ ID NO: 479 - DNA, 1394 bp, Brachypodium distachyon
tccctccctcgcccatcacctccgccatggccacagccgcggcctccctcctcgtaccgccttcctccgccgcgtgctgcgcggggccggccacgtcccgcgcgctgttccccacctccgttccctcgctgcgcgcctacccgcggctcctcctcgcgttccgccgccccgccgcggcggccgtcgcggacccgcagggcgcgggcgcggccgtgctagaggaagaggaggcggacgaccagacgcccgtccagttcgacgacgccgacgacgactacgaggacggctacggcgggcgcggccccgccttcacgcctcccacccgcccgcgcaccggcaaggccgccctccctctcaagcgcgaccgcacgaggtccaagaggtacctggagatacagaagctgagggagagcaagaaggagtacggcgtgcgcacggcactctcgctcatgaagcaggtctccaacgcccgattcgtcgagtcggcggaggcgcatttccgcatgaacctcgaccctaagtacaatgaccagcaactccgcgccacggtgaatttgcccaaggggacgggacaaaccgtcaaaattgcagttcttacccaaggtgagaagatagatgaagcgagagctgcaggagctgatattgttggcgcagatgacttgatcgaacaaataaaaggaggtttcatggagtttgacaaattgattgcatcacctgatatgatgcctaaggttgctagcttgggtaagattctaggaccaagaggattgatgcctaaccccaaagctggtactgtttctccaaacattactcaggctattgatgagttcaaaaaaggtaaagtagaattcagagttgacaagacaggaattgctcacattcctttcggcaaggttaacttccctgaagaagaccttattgcaaacttcatggctgttgttcgctctatcgagaggaacaaaccatctggtgcaaaggggatatattggaaaacggcatatgtatgctcatcaatgggaccttcaatcaagctgaacataaaagaaatgctcgactatggcacagaatcatctgactagatgtcatgacaagcaccaattaagccatccagcatttgataccaacttcacaaacttgaccattcatcccttgagataaacataccaagaaacacggttgttagggaagatttggaagtgcttaggtacagttttttttagtttcacgggcatccggcatcagcaattaaacaatgcccagaccaacaaacaggggggtaatgttggtcatttgtatttatgagcgaattatgcatgcacttatagatgtctctctctgagatgtttgttgtaagttcaatgttttgtcaatagtcatccttgagattatgccaa

SEQ ID NO: 480 - DNA, 1480 bp, Brachypodium distachyon
gcagccgccggcggcggaggagacgacgagggagatccaggtggtgcgcgaggcgtaccgcagggagcccgcggcgcccgcctacgtgatgcccgaggagccgcccgccatggtggagctcgtcgggtggtacctctacgggttctgctccttcttcatcacgcatctcttgctgcctgtgctcttccccgccatcgtcacccaggtcgccttcccggcttcagacttcacgccggaggccaagtacgtcgtcaagggcgccacctgctccgtccatgagatgtccatgtaccagaggctgaccaggcactccattgccattgctgattctaatctgtcgccgctgggctggagtggtctgtcatgggcaattggcatactcattgcggcgccgatcctcacccaggttgcgcaccaccttgaccgtggacagtaccagtcgcttatcctcattgctgccacgtcgtttggctcgttcttctgcctcctcactggcttcttcaagacagtttgggtgttcctgttctacatcctctttattgcttcagctatcatcgttgctgaggccgttcacacccgcaatcttggactgatgatccgtggccttgcggctcatgattcaggcaagcaccttgtccttcgtcgccgtgctgctgctagccagctcagtctgtactgcactgccattggtggtattggggctgcgctcatggctgcattcatgtatcacatgctaaggcgcactgaccagctcaccggcctctgggtcgtctccattttcagtggccttatctggttcattggcatctgccatggtcttttcacaaacaggccaagcagctcatcacccaccacagcatttgagcccaactttttcaccaagctcacctacagcatgaccatcgcccgttacccacaggccattggaagcttagtagcagtgttcctgtcatcttttgccacaatgtgcatcttcaccagtggcaccttgtatgctattggtggcgtttgcatcaagccagtccttgtgctcgtgctgtggatcctctacttcctgttccccttgatttcgcttccactgctccacccaattcagatcattatccgtgctgatgctgtccgcatgcagctgcttgggttcatcatcgcgctgttcgtgtcaggtgctgggttctatttcaagaaccacaggtggagggctgcacacatcatcgttattgcccttgtgcagagcacagccaacggtatcctgtactcatttggtcgtatcctgctgcttgacgcctcgccaccgggcaaggaaggtgcatttgctatctggtatgcatatgtacgctgcatcggtgcaatgatcggctttgctgctgcatcagctggccccgggcgtgcaggaggatcgttcgctgctgcattcctcggctgcttcctcggcatcattgtgctgatcttcggcaatgtcagcaacatcggggcgctgaag

SEQ ID NO: 481 - DNA, 833 bp, Brachypodium distachyon
gcgctgcccaaccgccggagatctcgtccaccgtctcgctcccccgcggttccagcgattccgtccgcctttccaaatggaatcctgtccttcggtgaagaacattctgttgctggattccgagggaaagcgcgtcgccgtcaagtactacacagatgattggcccgtgctctcgtcgaagctggccttcgagaagtcggtcttcgtgaagacccagaaagcaaattctggggcagaagctgagattgtaatgtttgatggtcacattgttgtgtataaattcatccaagacctgcacttttttgttactggaggagatgaggagaatgaacttattttagcatcagttcttcagggattcactgacgctgttgaccttattcttagaaataatgtcgagaaaagaacagcacttgaaaatctggacctgatcctattatgccttgatgaaattgttgatggagggattgtcctagaaacagaaggaagtgtgatagctgataaggtatcagctcatggagcagagggcggtacatcaatcgctgagcagaccatagttcaggccctaacaacagcaagagagcactttgccaaatctcttctaatgtgacgtgttgtgcttccgagatggaagacggaagtggcatccttatcacttgtatgcgcgggatggatgtgttcattttgttaacaaagaaggaaaagggagtctgaaactatgtatgtgtagagccgcatggttctggcgacattccctggttggtcagttttgtgagtgtagacaaagattgtgaattgtgattggacccattctttaccatgcttgtatactc

SEQ ID NO: 482 - DNA, 477 bp, Brachypodium distachyon
agttgtccttgttggtccatcctgacaaatgcaagcatccacaagcacaagaagctttcggagctctggcaaaagcacaacagctcctacttgatccacaggaaagagggtacattcttgatcaagttactgctgcgaaagaagagctgagggcaaagaggaaaaaagagctgaagaaagacagtgcatccaagataaaatcccaagtagatgagggaaagtacgaagagcagtttgaaagatcagacgaatttcagaagcagcttataattaaagttcgtgaaattttaacagacaaagaatggcgtcggaggaaaatgcagatgaggatatcagaggaagaaggaagattgaagaaggacgaggaggaaacaaaagaaatgtggaagaggaagagagagcatgaagagaagtgggaggagactagagacaaacgagtctctagctggagggatttcatgaagacaggaaagaagg

SEQ ID NO: 483 - DNA, 759 bp, Brachypodium distachyon
cacggcgagaacaggacacacgcaaggacggaagcgcagagctcttcgcctcttctgctcgcgacgacgacgacgatgagccccccccgcgtcctcctcctcctcgccgtcgtagcgacggcggcgtgcttcggcgccgcggtggcggatcagcccggatccggcgaggggtacacgatcgccggccgcgtcaagatcgacgctgcaagcggaaagggctttggtcttccagccaagacatcaaacactaaagtgatacttaatggtggtcagaaggttacatttgccaggccagatggctactttgctttccacaatgtgccagccggaactcatctgattgaagtctcgtcacttggctactttttttcaccagttcgagtggacatcagtgccaggaatcctgggcatattcaagcagcattgactgaaaacagaagagttctaaatgagctcgttttggaacctctgaaagaagagcagtactatgagataagggaacctttcaacgtaatgtcccttcttaagagccccatgggtttaatggtcggttttatggtcctaatggtttttgttatgcccaagatgatggagaacatagatcctgaggagataaagcaagctcaagaacagatgcggaactcacctgttccatccttttctggtttactagcaagagcaaacagctagatgtaggacacgtggacaacatgtgatttaagtctattttgtgacaaatatcagtactaaactgcttca

SEQ ID NO: 484 - DNA, 1348 bp, Brachypodium distachyon
ggaatcgatctgcagagaatctctatggttatcctgcatcagaagtacttggtcaggatgccctcatgctactggttgattcacgtgacctaagtgtggtaaatgatatgttccgacgtatttctttgggtgagagttggactgggaaatttccagtgaagaacagggcaggagataggtttttagctattggcaccaacactcctttttatgatgaggatggcagtttggtgggcattatttgcgtttcaaatgattcacatgccttggaggagatactcagtggaccttcaacctctgcaagttcccatttagaatcatctagacccacctgttgcgatggcagttgcagcaacaacaatcggaaaaacagtttgttgaacagaagtccatttgaccctcagcatcccctgccatctactatagcctccaagataacaaatttggctaccaaggttacaaataaagttcgttctcgggtcaggatggatgagaatggtgtggtacgggaaggtggcagcggtgagagtcaatgctctgatcgtgacaccaaggaagagccatcatctagtggaccaagtacaccaaaaggggatgcatcacgtggtgcctttgctacagaagagaattcccctgggaaatcagctaaaacaaatagtgatgaatcagaaggaaaaataggtctccacaagatcttgagttcaaaagcagaggcactgttgatcaagaaagggatatcatggccttggaaaggacgggagaatgatgggcctgatggaaagaatcaagtgatctggccatcattgcatggtgagcaagagattgaccagaatcatcagaaaatttctgacagtcaaggtgctgaatgcaaccaacctaacaaaaatgaagtatcaggttcctggtcctctttcaacaataacagctcaagcagtgcaagcagcactggaagtactaacagcagtgttctatacaaagttgaccatgaagcagactgtctggattatgaaatcctatgggaggatcttgtcattggagaacaagttggccaaggctcttgtgggacagtataccatgcgttgtggtatggctcggatgtgggtgtgaaagttttctccaggcaggaatattcagaagaagtgatacaggcctttcgacaagaggtatcccttatgaagaaactacgtcatcctaatatcctgctcttcatgggggcggttacatctccacaccgcctctgtatcgtaacggagttcctcccacgtggaagtttgtttcgcttacttcaaagaagcactaccaagttggattggagacgacgtgttcacatggctttggatgttgtaag

SEQ ID NO: 485 - DNA, 1789 bp, Brachypodium distachyon
tggagagcgagcgagtgcgagagggagaaggagagaagcttccgatttcctccatatagatactctagatccattttcatccatcaaatcgccctagccgccgttgctgcacctgcccgctctgctctgctcggctaccaagggttttgcgagaccatggcgaggaagatgctcaaggacggggaggtggccgtggccgacggcggcggcggcgagagctacgagtatgacctgttcgtcatcggcgccgggagcggcggcgtccgcggctcgcgcacctccgcgggtttcggggccaaggttgcgatttgcgagctcccattccaccccattagctcggagtggcagggagggcatggtggcacatgtgtgatccgtggttgcgtccctaagaagatactggtctacggggcagcgttccgtggagaatttgaggatgcaaagaattttgggtgggaaatcaatggggacataaactataattggaaaaagttgctggagaataagactcaagaaattgtcagactaaatggagtatacaagagaatccttggcaattctggtgtgacgatgatcgaaggggcaggcagtgtagttgatgctcatacggttgaagtaacccaaccagatggttcaaagcaaaggcacacggcaaaacacatattgattgcaactggtagccgagctcatctggtcgacattcctggaaaggagttggctattacctcagatgaggctttaagtttagaggagctaccaaaacgtgctgtaattcttggtggcggatatattgctgtcgaatttgcttctatctggaaagggttgggtgctgaagtagacttgttttatagaaaagaacttcctctaagaggtttcgatgatgagatgagaacagttgttgcaagtaaccttgagggaaggggaatcagattgcatcctgcgacaaatttaactgagttgagtaaaacagccgatggcattaaagtcgtgacagataaaggagatgagctcatggcagatgttgttctgtttgctacaggtcgcacaccgaacactaataagttgaacttggaagctgttggtgttgaagttgatcaaataggagccatcaaggtggatgaattctcccatacatcagttcccagtatatgggctgtgggtgatgtaacaaatcggattaacctgacacctgttgcactgatggaggctacttgctttgctaaaactgtgtttggtggtcagccagttaagcctgattacagagatgtaccttgtgcggttttctcaattccacctctatctgtcgtgggtctcagcgaacaagaggctttggaggaagcgaagaatgatattcttgtttacacatcaagtttcaatccaatgaaaaacagcatatccaaacggcaggagaagtctatcatgaaactggtagttgattctgagaccgatagagtactcggtgcagccatgtgcggaccagatgcagctgaaatcatgcagggcattgctgtcgcgctcaagtcgggagctaccaaagcaacctttgatagcactgttggcatccacccttctgccgcagaagagtttgtgactatgcggaccttgaccaggcgtgtgagtccagcatctaagctgaagacaaacttgtaagcaagatacgcaataagttggaccaaaaatatacatctgtttggtttgctgtggctgtatactcaggctcttgatttcagtctggtagctctacgtttggcacttgaacctgaaagggtaaaaatgtcaacactgtatt

SEQ ID NO: 486 - DNA, 1215 bp, Brachypodium distachyon
agggattacctcgtccgcaactccggcgagcaggtgaagatcagcagcattgaggcaggcactgtggctctctacttctcggcctcatggtgcccgccatgcaggcggttcacgccgaagcttatagaggcatacaaagagcttgcctcacagggcaagagctttgaggtggtctttgtttcaggtgatcaggatgaggaagcattcaatgcctactttgctaagatgccgtggttggcagtccccttcactgactctgaaggtcgtaaaagccttgatgagcggtttcaggtccgcggtattccacaccttgtcatccttgatgcaaaaactggtaaagtttgtactgaagatggagtcgagtttgtgagtgagtatggaatagatgcttatccttttacacctgagaggatcaatgaattgaaggaacaagaaaaggcagctaaggataatcaaactattcatagtgtgcttagtacaccgactcgtgactacttaatttcaaacaagggggacaaggtacccatctctgatcttgaggggaaatatgttggtttgtgctttgtggtgagtggttatggtccagttgaggaatttaccacagtgcttgccaagatatatgggaaactcaaagaagtgggggaaaagtttgaagttgtagctgtatccatggacaacgatgaggcatcgttcaatgagagttttcaaaacatgccttggctcgccattcctcagggtgacaagatgtgtcagaagctggtcagttactttgagcttaatgatcttcctacacttgtgctgattggtcctgatggaaagacactgaatagcaatattgcggacataattgaagagaatggtgtggagtcatgggaggggttccccttcaatgcagagaagctggaaattcttgctgagaaggcaagggctaaagcagagtcacagactttgcagtcccttctggtcactggtgatttagactttgtcattgggaaagatggagcaaaggttcctgtgtcacaacttgttgggaagactgtcctcctttacttttcagctcaatggtgtggaccatgccgagccttcctgcctacacttgtcgatgtatacaacaagatcaaggaaaagaatagtgactttgagattgtcttcatctctagcgacagggaccagagctccttcgatgacttcttctctggcatgccatggcttgcc

SEQ ID NO: 487 - DNA, 534 bp, Brachypodium distachyon
agtttatttcggttgcttcaaaagaacactggcaagctggatcccagaaggagagttaacatggctatagacatagcaaggggcatgaattatcttcacaattccatccccactgttgtgcaccgtgatttaaaatcgtcaaacctgttggttgataagaactggactgtaaaggttgcagactttggtctttcacgtctcaaacttgaaacatttctgacgacaaaaactggaaaaggaacaccgcagtggatggctccagaggtgttacgaagtgaaccttcaaatgaaaagtctgatgtatacagctatggagtggtcctatgggagcttattactcagaaggtaccatgggatactctcaatacaatgcaggttattggagcagtgggtttcatggatcacagactggaaattccaagcgacgcagaccctcagtggtcatcgatgatcgagagttgctgggtcagtgacccgcaacgccgcccttcattccgagaactcctggagaggctccaggtgctgcaaaagcag

SEQ ID NO: 488 - DNA, 1187 bp, Brachypodium distachyon
ttccaaaccaaacgggacaatcaccacgacctcgagccgctccgtctccgttcctccgcttgtagtccactaccctccatccaagaccgaaggcgccggatggcagcggcatccaccacagacggcggcgtcggggccatcctcactgccggtgagagggactacctcgtccgcaactccggcgagcaggtgaagatcagcagcattgaggcaggcactgtggccctctacttctcggcctcatggtgcccgccatgcaggcggttcacaccgaagcttatagaggcatacaaagagcttgcctcacagggcaagagctttgaggtggtctttgtttcaggtgatcaggatgaggaagcattcaatgcctactttgctaagatgccgtggttggcagtccccttcactgactctgaaggtcgtaaaagccttgatgagcggtttcaggtccgcggtattccacaccttgtcatccttgatgcaaaaactggtaaagtttgtactgaagatggagtcgagtttgtgagtgagtatggaatagatgcttatccttttacacctgagaggatcaatgaattgaaggaacaagaaaaggcagctaaggataatcaaactattcatagtgtgcttagtgcaccgactcgtgactacttaatttcaaacaagggggacaaggtacccatctctgatcttgaggggaaatatgttggtttgtgctttgtggtgagtggttatggtccagttgaggaatttaccacagtgcttgccaagatatatgggaaactcaaagaagtggggaaaaagtttgaagttgtagctgtatccatggacaacgatgaggcatcgttcaatgagagttttcaaaacatgccttggctcgccattcctcagggtgacaagatgtgtcagaagctggtcagttactttgagcttaatgatcttcctacacttgtgctgattggtcctgatggaaagacactgaatagcaatattgcggacataattgaagagaatggtgtggagtcatgggaggggttccccttcaatgcagagaagctggaaattcttgctgagaaggcaagggctaaagcagagtcacagactttgcagtcccttctggtcactggtgatttagactttgtcatcgggaaagatggagcaaaggtatgtcttacgtatgcttgatt

SEQ ID NO: 489 - DNA, 1324 bp, Brachypodium distachyon
cttcccgtgacgtgtgctatacttatatgcttgtttgctctgcaacactacggtacacacagagttgggtttctctttgcgccaattgtctgcatttggcttctctgcataagcacgattgggctctacaatatcatccgttggaaccatcatgtgtatcgagccctttcgccgtactacatgtatcagtttctcaagaagactcaaacaggtggatggatgtcactgggggggatccttctctgtgtaacaggctcagaagctatgtacgcagatcttggacatttctcacaagcttcaattcagattgcattcgtatcagtggtttatccatctctagttctggcttatatgggacaggctgcttatatatcacaacaccacagcttcgagagtagctatcatattggattctatgtgtcagttccagaaaaactcagatggcctgttctagtgattgctatactagcagccgtagtcgggagccaagcaatcattactggtaccttttcaatcatcaagcagtgttctgcgttaagttgtttccctggtgtaaagattgtgcacacatcatctacggtgcacggtcagatatacatacctgaagtcaattggatcctgatgatactctgcctggctgttactattggcttcaacaacacaaagcacctggcgaacgcacaaggtctcgcagtcataactgtgatgctggtcaccacttgtttaatgtcattggttattgtgctttgctggaacaagagtatcttccttgcccttggtttcctgcttttctttggaacgatcgaagtactttacttctcagcttcccttgtcaagttccacgaaggtgcttgggtccccattacactttccttcatatttatgatagtcatgtctgtgtggcactatggcacgataaagaagtacgaattcgatgtccaaaacaaggtttcagtaaactggttactgaacctcggcccttcactgggaattgtccgtgttcgaggcatcgggcttatacatactgagctaatgtctggaattccggcgatattctctcatttcgtaacaaatctgcctgcatttcaccaggtgctggtctttctctgcgtcaaatcagttccagtgccacatgttgaacctgaagaaagatttctggtgggccgtattggaccaaaagagtacaggctatacagagtcatcgtcagatacggttaccgtgacgtacagcaggacgacctagagtttgagaaggacctcattcacagcattgcggagttcatccgcagtgggggatccgaccagaatggcctcatggaaggtt

SEQ ID NO: 490 - DNA, 1087 bp, Brachypodium distachyon
tcttctccggcgagccaccggcgatggggagtagccgctgccgcgggcagcgccagctccagctgtggttccgattcctcgccctctcgtcgctgctcctccttgcttccggggaggtcatcttcgaggagcgcttcgaagatggttgggagactcgttgggtgaaatcggattggaaaaggagcgaagggaaagctggtacattcaagcacacggcaggaaaatattctggagatcctgatgacaaaggcatacaaacgacaatagatgctaggcatttcgctatctcggccaagatcccagaattcagtaacaagggccgaaccttggtggtccagtattccataaaatttgagcaggacattgaatgtggtggcggctatattaagctaatgtctggttatgtcaaccagaagaaatatagtggggacactccatacagcttgatgtttgggccagatatatgtgggactcaaacaaagaagctgcatcttatactttcttaccaggggcagaactaccctatcaagaaagatttgcaatgtgaaaccgacaggttgacacatgtttacacattcattcttaggcctgatgcatcttacagtatacttgttgataaccgtgaaagagaatcggggagcatgtacacggattgggacatcctacctccacgtaaaattaaggacgtcgatgccaaaaagcctaagaattgggatgacagagagtacattgaggatcctgatgaagttaaaccagagggctatgattctatcccgagagagattcctgatccaaaggacaaaaagcctgacacttgggacgatgatgatgatggcatatggaagcctagaaggataccaaatccagcatacaagggacaatggaagcgcaagaaaattaagaatcctaactacaagggtaaatggaagatcccatggattgataatccagagtttgaggatgatccagatttgtacgtgctaaaacctttgaagtatattggaattgaagtttggcaggtaaaagctggttcagtttttgacaacattctcatttgtgatgacccggagtatgcaaaaaaggttgc

SEQ ID NO: 491 - DNA, 832 bp, Brachypodium distachyon
agggatacagacaaccttggatgctaggccatttcgccatatcggcaaagtacccggagttcagtaacaagaatcgggacgttggttgttcagtattcgataaagatcgagcaggatattgaatgtggcggtgcttacatcaagcttatgtccggttatgtcaaccagaagaaatttggtggtgacacgccttacagttttatgtttggtcctgatatatgtggcgatcagacaaagaagctccatctcatactttcgtaccaaggggcaaaactaccctatcaagaaagatctaaaatgtgaaacagataaggtgacacattttctacacattcattcttagacctgatgctgtcttacagcctacttattgataaccgggagagagaatttgggagtatgtacactgactgggacatccttcctcctcgtaagatcaaacaagtcaatgctaaaaagccaaaagattgggatgacagggagtatattgaagatcctgatgaagttaagccagagggatatgattctattcctaaagagattcctgatccaaacgacaaaaagcctgagtcatgggatgatgatgaggacggtatatggaagcccagaatgataccaaatccggaatataagggaccatggaagcacaagaaaatcaagaacccaaactacaagggaaaatggaaggccccatggattgataatccagaattcgaagacgacccagacctatacgtgctgaaacctttgcagtacgtgggaattgaagtttggcaggtgaaagctggttcagttttcgacaacattttaatttgtgatgaccctgaatatg

SEQ ID NO: 492 - DNA, 1376 bp, Brassica napus
ggatatttgtggtgatggtggtttgttcaagaaggttattgcggaaggagagaagtgggagaagccaaaggaccttgatgaagtgtacgtcaagtatgaagctcggctcgaggatggaactgttgtgggaagatctgatggtgcaaagttcactgtcatggatggccatttctgtcctgcgatcgctaaggctgtcaagaccatgaaaagaggggaaaaggtgctcctaactgtcaagccacaatatggctttggggaaactggaagagcagcgtccgattgtattcaagctgcagtccctccgaatgcgactcttcagatggaccttgagttggtgtcttggaagacggtggtggaagtaactgatgacaagaaggtcattaagaaaatactgaaggagggagaaggatatgagcgtccgaatgaaggagcagttgtcaaattgaagttgattggtaagcttcaagatggaactgtgttctttaagaaaggtcatggagaagrcgaggagccgttcgagttcaagacygatgaagaacaagttattgaagggctggagaaagctgtgatgggcatgaagaagggtgaggtggctctcatcaccatctctcctgaatatgcctttggttcctctgaatcaaaacaggagctagctgtgataccaccagactcgacagtttgctacgaggtcgagctggtatccttmwttaaggagaaagagtcykgggacatgaacacacaggaaaagatagaagytgctggcaagaagaaggaagaagggaatactctattcaaggctggaaaatatgcaagagcttcaaaaagatacgagaggggtgtcaagttcatagagtatgactcctctttcgatgaagaggacaaaaagaaggctaaagctctgaagattgcttgtaacctgaacaatgcagcttgcaagctgaaactgaaagattacaaagaggcggcgaaactgtccactaaggtattggagatggacggaagcaacgtgaaggcaatgtacaggagagcacaggcgtatatggagacggctgatcttgatcttgctgagctcgatatcaagaaagtccttgaaatcgatccggacaacaaggaggtgaagatggagtacaagaagctcaaggagaaggtgagggagtacaacaagaaagacgctaagttctacagcaacatgctggccaaaatgctcgagccacataaagaagcacgcaaggatgcacaagcgatgagcattgacgccaaggcatgagtcgaaacataaaatgtattacaaatttctktytrtcccattttgtaaamgatcttkgkgtgyggggtactgttgtggatgattttgctcttataataaatcagacttt

SEQ ID NO: 493 - DNA, 1627 bp, Brassica napus
atcagaacagaaactattctcacttctgttttgtttttgtcttccgtctccagatctctctctctcagattcatagcccaaagtcaaccagtcaacaaaaagtctctgcctttgctgagaattcaaggggttttttttcgatgatagcgaggatcctcgccggtttcatggagagtccggcggtggctgctgccggcgactctgttctaggtacaatcaaaatcgcggtgatgcctatagctaaagtgttcaccatgtgcttcttgggtcttctcatggcttctaagtacgtcaacatcttgcctccctctggccgcaaactcttgaacgggttggtcttctcgcttttgcttccgtgcttgatcttctcccagctcggacaagctgttactctccagaagatgcttcaatggtggtttattcctgtgaacgttgttcttggtacaatctcggggtctttaattggcttacttgttgccaccattgttcgtcctcctcacccttatttcaagttcaccatcatacaaatcggagttggtaatattggcaatgtgcctcttgtgttactagcggctctatgtagggacacctccaacccctttggtgactctgaaaaatgtagcattgatggcactgcttacatctcttttggtcaatgggttggtgccatcatcctctacacatatgtgtaccagatgttagctcctcctcctgaagggtttgatggcgaacatgacaaccttcctttgaaaaaccttccactagattcctctgctccagagcagtccccttgcttactcmaaatcrcactaaggacgtttcatccattcaggttcacctccctgtacagaccgcagaacctagarcaagagtagtagattcaaggaaaagcaagattacacagttctttgtttacctctatgagaagttgaaactgaagcaaatcatccaacctgcaataattgcttcaattcttgccatgrtacttggtgcaatacctttcaccaagaagttgctcttyacaaacggtgcaccacttttcttcttcacagatagctgcatgattcttggggacgccatgatcccytgtatattrctggcacttggtgggaatctcrtcaacggaccaggaagttcaagacttggtttcaagacaacagcggcgattatattcggacggttggtgttggtgccaccagtaggactggggatagtgacattagcagacagacttggtttccttccagctggtgacaagatgttcaagtttgtgttgctattacagcacacaatgcctacctctgtgctctcaggtgctgttgcaaaccttagaggctgtgggagagaatcggctgctgtgctcttctgggttcacattttcgccatcttctcaatggctggatggatggtgctgtatatcaacattctcttctaaagtcattcatctcacactatgctgtaaatacaggggcatcttcaacaaacctaagattagttttttttttatctacttgtgtaaatgtgagtttatgactctcacctagtactgcaacatgagctgagttcttgttttttcttttctcgaaaaatygaargtmtatcataggttgtgacccaaaaaaaaaat

SEQ ID NO: 494 - DNA, 729 bp, Brassica napus
aaagtagacgacgatgckattctaaaatccttcctmgcsgaggtyggtgaggttgagagggacaacgaagtcgtcaggattctctcatgyttcaagctgaacccgtttgagcaycttaacytatctttcgactcttccacggatgatgttaaaaggcagtacagaaagatatctttgatggttcaccctgacaaatgcaagcatccgcaagcacaggaggcttttggagcgttggcaaaagcgcaacagctactgctsaacgaccaagaaagrgattatattctcacccaagtccaggctgccaaagaagagcttaagatgaagagaaaraaacagttgaagaargataccgcctctaaaataaagtccttggttgatgagggaaagcatgagcaaatatatgagcaatctgaagagtttcagaaggagctgaagttaaaggtccgagagatattaacagaccaagagtggcgtaggagaaaaatggccatgaggatatcagaagaagagggaagactgaagaaggatgaagaagarcaaaaggagatacggaagaaraarcgtgagcatgaagaacagtgggaaggaactagagaaaacagggtatcaagctggagagacttcatgaaagcaggaaagaaggccaaraagggagagacrcgyccyccaaaactgaagacagaggatccaaacaaatcatacgtccaaaggccggtcaagaaaggctga

SEQ ID NO: 495 - DNA, 677 bp, Brassica napus
cgatcgaaaccaaaaaataaagttgtagcgagaaagaatcaacatggcgagtttactagataaagcaaaagatttcgtggctgataaactcgccggggttcctaaaccggagggttcggttacggacgtcgaccttaaagacgtgaaccgtgactccgtcgagtacttagccaaagtttcagtcaccaatccttacggtcacgcgattccgatctgcgagctcaatttcactattcacagcgctggccgggaaattggaaaggggaagataccggaccctggttcactgaaagcaaaggacatgacggttcttgatgttccgatcgtagtgtcgtatagtatactgttcaacttggctcgagacgttggtgcggactgggacattgactatttgctcgaaataggtctctccattgatcttcctgttctcggggattttactattccggttaccagcaagggcgaaatcaaactccctacttttaaagactacttctgagtcaactttacgctgttaaaaacaaaacaaaaacaaatatcgtttgtactagtgataaaatgtaataactaataagtgtggtttgcctataaaatcattaaatatcttttttaatgtatgtttttattcatacagttaataaatcaaagtttaaaactaataaatgaaaatttggaag

SEQ ID NO: 496 - DNA, 1133 bp, Brassica napus
ggagtttcgagaaaacgattctttatgtttggaggcccacactaccagatctattctcgaccgttagatcacgtggacgagtccactccccttggtttcttttaaccagtccctctcattcctcaacgtgttgtgaagatacttgctgtttcaagaagacaggcgataactccgaagagcaaaaaaaaaaagagaaagagtcgttggtagaaatctcaaataaagaacgatcagatggagacggagaagaagaagaacagccaggagctaggtctgaaacacctagggttcgtgagagttgcggcgatccatgttcttgttagcctctcgagcctttacgactacgcaaaacaaaactccggtcctcttaaaccggctgtggggaaggttgaaggagccgtcaccaccgtcgtcacccctgtctacaataaactcaaggatgttccagataccctcctcctctttctagatcacaaggtgggtgaagcttcggacaagtttgataagcatgctcctccagtggctaagaaagtagtaagtcgagctaatgtgttgatccacaagactacagagaaggctcaacgctttgtgaaagaggctcgtacgggtggtcctaaagctgcttttaactatgctgcaaccgagtacaagtgtttccttgtcactaactcggtcagagtctgggccaaactcaaccggtttaaaccgattcatgcagtggggaacaaagcttttcccgtggctgcacacgtgtctggtatttacaacgatctggtgacggacatgactcagatgggttaccctgtggttggttatcttcctttagttcctgtcgatgacatcgtcaaggcttatgaaaaggaggaaggtgcagcgcagaagaaaggagatgttacagatggaaacgattcgtcgtctgattcggacactgattgataacgcttgtgtgatgattgaagacgtttggttggtttggtttggttacttaatgtaaatgatcttattaggcactctcttgttttttttagcaagtgtttcatttcttggtggtgtgacaatgtgatatgcgtttgcttctgtcttttttcaaccaggagaaatataatattgagcaacagaactataagaacatc

SEQ ID NO: 497 - DNA, 793 bp, Brassica napus
gacacacagtttctctacacagaaacatacactttcaaaaaaagctttatataattatcgtttcatatttcacacatttgaaggggaaaaaatggcctccaaccaacaaagctacaaagctggtgaaactagaggcaagactcaggagaagacaggacaagctatgggagcaatgagggacaaggctgaggaaagcaagaacaagacttcccaagcggcccaaacagcccaacaaaaggcccatgagacggcacagtctgcaaaagataagacatctcaaactgcccaaaagacccagcaaaaggctgacgagacgacccaatcagcaaaaggcaagacatcccaagctgctcagacggctcaagacaaagcccgtgagacaaaggacaagacggggagctatatgtccgagacaggagaagccataaagcacaaggctcaagacgctgctcagtacacaaaggagacggctcaaggcgcggctcagtatacgaaagagactgctgaagctggtaaagacaagaccggtgggttcttaagccagactggtgagcatgtgaagcagatggctatgggtgcagctgatgcggtgaagcacacttttgggatggctaccgaggaagatgacaaggaacattttccaggcacaactactggtactactcggaccactgataccactcatcagacgtatcagaggaagtgagaataacaagagaactatgattgtgtctttctcttgtttctataatgtcgcatgtttggtcttttgagtttctgttgagtctttatg

SEQ ID NO: 498 - DNA, 973 bp, Brassica napus
gaaggcagtgcctatttttatgagacatgctcacatgaacaacaaaacacgaagaatcataagctatcttcttgtaacattttgatttttactaaggaagaaagattaaaaaaaatgcagtcgatgaaagaaacagcttcgaacattgcagcttctgcaaagtctggcatggacaagaccaaagctaccttggaggaaaaggcggagaagatgacgacgcgagaccctgttcagaaacagatggccacacagaagaaagaagcaaagattaaccaggctgagatgcagaagagagaagtgcgtgagcacaacgctgccatgaaagaagctgctggaggtggaaccggaaccggtttaggtttggggtcagccactcactcaaccactggacacgtcggacatgggactgggacccaccagatgtcagatttgcctggtcacggaacgggacaagcaaccggacacgttgtggagagaacgaccttgacagaacctatcgggacaaacactggaactggtcggaccgctgctcataacgcccacgttggtggtggcaccactgggtacggaactagtggaggatacactggataaggcgatttctcatatatatgcttttgtgtgttcatattgcttttcgggtcctaccttttgttttctctcctaataaatatggtttcttttcttgtttttttttggtctggtgacagacttaacgttgtgtctttcttataataattatgttaattttcagtaaaaaaaaaaaaaaagggcggccgctcgcgatctagaactagtgaacgatcacaaatatcgactaaatccaaccttgacttcaaattatccgtcgttttaccttggatgttaaggactgtgttcatcagattatcgaagaagttcttctcaatatgcatgacatctaaattatgccgcaatagatgacgctcccaatatggcagagcccaaaaaactc

SEQ ID NO: 499 - DNA, 1188 bp, Brassica napus
  misc_feature (1167)..(1167): n is a, c, g, or t
  misc_feature (1169)..(1169): n is a, c, g, or t
ggagatcgacgaacttaaacatctaaacacattattttatctgctgtagagaaaaaaatgggagttagagagaaggatccgttagcccagttgagcttacctccaggttttcgtttttacccgacagatgaagagcttcttgttcagtatctctgtcggaaagttgcaggctaccatttctctctccagatcatcggagatatcgatctctacaagttcgatccttgggatttgccaagtaaagctttgtttggggagaaggaatggtacttctttagcccaagagatcgaaaatatccgaacgggtcaagacccaatagagttgccgggtcaggttattggaaggcaacgggtaccgacaagatcatcatgtcggatggtcaccgtgtcgggattaaaaaagctctggttttctacgccgggaaagctccaaaaggcacgaaaacaaactggattatgcacgagtatcgactcatcgagcattctcgtagccatggaagctccaagttggatgattgggtgttatgtcgaatctacaagaaaacatctggatctcagagacaagctgttgcttctccggtacaagcttgccttgaagaccagagcacgaacatgtcgtcgtcgccgtcttcttcgtctcagctcgacgacgttcttgattcgttcccggagatgaaagaccggtcttttgatcttcctcggatgaattcgctcaggacgattctcaacggcaatttcgaatgggctagcttagcaggtcttaatcccatgcctgagctagctccgatgacctacggtttatcgaattacggaggttaccacgcgttccaatcggcggagagcgggtgtaggagttcgcaggtcgatcaggagcagaactcgaccgagttgactcagagtctcgggtacagctcgagcgggttcggactttcgggtcaaatgtacgagtttaggcaatgagagatgggttaatgtaatttggctactcatatgagtggacgcggttaaaaaaagtaaaaaaaacctagagtggcaattatgtaaacaaatagagaattataatgggccttcttaaccgattcggttaggcttaggattccagaaagcgaaggccttgagattagtttttatctaatatgacggaccgaaaatgtaatagcgcacgcncnctacgttaatgggctcttt

SEQ ID NO: 500 - DNA, 1147 bp, Brassica napus
cggagagcagctggcgccataaagaaaccattttaatatgctgaggaacttgatatgggcaacatcaaagcacgatgtgtatttcatgaagaactactccctcatgcattggtcatctttgcttcaaaggagcaaagaagtacttaacgtggctaagcccattgttcctacgatgaagcatcctggatcgttgtcgcagtccatatcaagagtccagataagcaccatggcagttaaagacgatttgatagttgccggagggttccaaggagagcttatctgtaagagagtcaacgaacctggagttgcattctgtactgttctaacatcggttgaaaacgacatcacaaactcggtcgatatatacaacacaccaagtggctcgttaagagttataaccgcgaacaatgactgcaccgtccgtgtacttgacgctacaaactttgctttcctcaacagttttacctttgactggtcggtaaataacgtgacggcaagtccagacgggaagctagtagctgtcttaggagacagtcccgagtgcttactagccgaggcaggatcaggtaaagtgatccatgccctcgaaggccatctcgactactcgttttcatcagcatggcatccaaacgggcaaatcctagccacggggaaccaagacacaacatgcaggctatgggacgtgaggaacttatctaagtcgctcaaagtgttgaaaggaaacatgggagctattagagcgttgaggtttrcttctgatggacggttcttggccatggctgagccagcagactttgtkcacgtstttgacacggaagctggttatagtcagtgtcaagagattgatatgtttggagaartagctggaatatcgtttagtcctgacacggaagcactgttcgtgggagtggctgatcgtacatacggtagcttgttggagtttagtaggaagcgtaaccacttgtacttggattccattttctgatctgactccagtgagctctatgtgtgtgagaggttatgttacgacgttggtaagggttaagtcgttgtttttgtggacttttgtacctttgtttsccmctttatgtaagtttattgatagatatattaggccatgattatccctaagagggttttttagttt

SEQ ID NO: 501 - DNA, 901 bp, Brassica napus
gagatcgacgaacataaacatataactttcttggttttcttagagttcgaaacacatttagattgttttgtctgctgaagaatcgaagttagggggaaatgggtgttagagaaatggatccgttagcccagttgagcttaccaccgggtttcagattttacccgacagatgaagagcttcttgttcagtatctctgtcggaaagttgcaggctatcatttctctctccaggtcatcggagacatcgatctctacaagttcgatccttgggatttgccaagtaaggccttgtttggggagaaggaatggtatttctttagcccgagagaccggaaatatccaaacgggtcaagacccaatagagtagccgggtcgggttactggaaggctacgggtaccgacaaaatcatcacgtcggatggccaccgtgtcggaattaaaaaagctctggttttttacgccggaaaagctccaaaaggaaccaaaacgaactggatcatgcacgagtatcgcctcgtggagcattctcgcagccatggaagctcaaagttggatgattgggtgttgtgtcgaatctacaagaagacgtcggggtctcagagacaagccgttgctccggttcaaccttgccgcgaagagcacagcacgaacgggtcgtcgtcgtcttcttcgtcacatcacgacgacgttcttgactcgttcccggagatgaaygatcggtctttcaatcttcctcgggtgaattctctgaggacgcttctcaacgggaacttcgactgggctagcttagcgggtcttaatccaatcccggagctagctccgacgagcaacggttacggaggttacgatgcgtttagagcggcggagggagaggcggagagcgggttgaggaatttgcagat

SEQ ID NO: 502 - DNA, 1078 bp, Brassica napus
ggaagtccatccctttcgttttacaaccaatcctcgacctgatgtgaaagatactttactgctttaacacaatatagagagagaccactagtagtgaccggcaagagacttctgaaccaaatctaaagagctctcagcacacagcaaaagaaaactaggtaaagagctgttgagttgtttctttggtgtgtagatggaaacagagaaaaacagcaaggagctagggcttaaccacctagggttcgtgagagttgcagcgatccatgttcttgttagcctctcaaacctatacgactacgccaaacaaaactctggtcctcttaaaccggcggtgggaaaggtggaaggagccgtcaccaccgtcgtcacccccgtcttcaacaaattcaaagatgttccagatactcttctcctctttcttgatcacaaggttggtgaagtttcgaacaagtttgataagcatgctcctccactggctaagcaagtagtaagccaagcacatgtactgatccaggcgactacagagaaggctcaaagctttgtgaaagaggctcgtactggtggtcctaaagctgcctttaactatgctgcaactgagtacaagtacttggttgtgactaactcggttaaagtctgggctaaactcaaccagtacaaacctattcatgcagtgggaaacaaagctttgccactggctgcaaacttgtctggtatgtacaacgatttggtgactaacatgaccaagatgggttaccctgtggttggttatcttcctttggttcctgttgatgacattgtcaaggcttatgaaaaggaacaagatgcagcgcaaaagaaaggagatactaccactgctactgatgggaacaaatcatcttctgattcggacactgattgaaacatttgtgagcctggtttgttgggtttggtaacttgtgtaaatgatgttaggctctttcttgttcttctttgatcacagaacttggtcttgtagtgtttcatttgttgttggttgatgtgtgtattttctatctatgtaacaaagaaggtaataatattgagcaacaaaactttaaga

SEQ ID NO: 503 - DNA, 830 bp, Brassica napus
gcttctcaagagagatagaacaaggtctaagaggtttctggaaatccaaaagctaagggaaaccaaaaaggagtacgacgtcaagactgctatatctttgcttaagcaaaccgctaacacaaggtttgtggagtcggtcgaagcccatttccgtctcaacatcgatcctaagtacaatgatcagcagctgcgagcaaccgtgagccttcctaaaggaacagggcaaactgttaaagtggctgttcttgcacaaggtgagaaggtcgatgaagcaaaaaatgcaggggcagatattgtgggcagtgatgatttgatcgaacagataaaaggagggttcatggagttcgataagttaattgcatccccggatatgatggtcaaggttgctggcctgggaaagattcttggtccacgaggactcatgccaaatcccaaggctggtaccgtcacagctaacattccacaggctatagaagagttcaagaagggaaaagtagaattcagagcagacaaaactgggattgttcacattccgtttgggaaagtgaatttcacagaggaagacctgctcgtaaacttccttgcagcagtgaaatcggtggagacaaacaagccaaagggagcaaaaggagtgtactggaaaagcgcacacatatgttcgtcaatggggccatccatcaagttgaacataagggagatgatagacttcaagccataaataaccacatttgtgtttttttttttgtgagtgtaggcgaacaccattagttatctcttgtatacctcaccggttgtatcaccttaactctgataagaccatttgctttatg

SEQ ID NO: 504 - DNA, 978 bp, Brassica napus
gttgtgaagatacttgctgtttcaagaagacaggcgataaacaccgaagagcaaaaaagagaaagagtcgttggtagagatcttaaataaagaacgatcagatggagacggagaagaaaaatagcaaggagctaggtctgaaacacctagggttcgtgagagttgcggcgatccatgttcttgttagcctctcgagcctctatgactacgcaaaacaaaactccggtcctcttaaaccagcggtggggaaggtggaaggagccgtcaccaccgtcgtcacccctgtctacaataaactcaaggatgttccagacactctcctcctctttctagatcacaaggtcggtgaagtttcgtacaagtttgataagcatgctccaccagtggctaagaaagtagtaagtcaagctagtgtattgatccagaagactacagagaaggctcaacgctttgtgaaagaggctcgtactggtggtcctaaagctgcttttaactatgctggagccgagtacaagtgtttccttgtgactaactcggttagagtctgggccaaactcaaccggtttaaaccgattcatgcagtggggaacaaagcttttcccgtggctgcacacttgtctggtatttacaacgatctggtgacggacatgacgcagatgggttaccctgtggttggttatcttccgttggttcctgttgatgacattgtcaaggcttatgaaaaggaggaaggtggagcgcaaaagaaaggagatgctgctgatggaaacaagtcgtcgtctgattcggacactgattgataatatgcttgtgtgatgattgaagacgtttggttggttgggtttggctacttatgtaaatgatcttattaggccctctcttgtttttttttagctagtgtttaatttcttggtggtgtgacaatgtgatgcgtttgtttctgtcttttttcaaccaggagaaatataatattgagca

SEQ ID NO: 505 - DNA, 1365 bp, Brassica napus
taaaaacaaaatcctgaagtcaattgcttggtcaagattcgctttttttaacatctctactctcttaaggattcatggacttctcgaactcctgagtccccccagaaacccaccatggatatcgaatccagaagttatcagaacaccgtcaagaaggaatcatggagaacggtactgacattagcctatcagagcttaggagtcgtgtacggagacttgagcatctctcctctttacgtattcaaaagcaccttcgcggaagacatcgaacactccgactccaacgaagagatcttcggcgtcttgtcgttcatcgtctggaccatcaccctcgtccctctcttcaaatacgtcttcatcgtcctcagagccgacgacaacggcgaaggaggcaccttcgctctctactccctcctctgccgtcacgcacgggtcaactcgctcccgagctgccagctggccgacgagcagctcgccgagtacaagaccgagtcgccgtcggaggaggagatgggccctccgtcggggttygcggcgaggttgaagtcgacgctygagaagcggagagtgytgcagaaggttttgctygtkctrgctttgatcgggacttgtatggtgatyggtgatggtgtcctaacgcctgcgatttcmgttttttctgcagtatcaggtgttgagctttcaacggccaaggagcatcacaagtatatagaagtacctgctgcttgtgtaattctgataggtttgtttgcgcttcagcactacggtacacacagggtggggttcttgttcgccccggtgattctcttgtggcttatgtgcatcagcgccattggtgtttacaacattttccattggaacccgcatgtctaccaagccctctctccttattacatgtacaagttcctcaagaaaactcagagtaaaggttggatgtctctcggtgggatcttgctctgcattacaggctcagaagcaatgtttgcggatctcggtcatttctctcaactctccatcaagattgcttttacatcacttgtgtacccgtctttgatactggcttacatgggacaagcagcttatctatctcagcatcatgtcatcgacaccagttacaacattgggttctatgtatctgtgccagagaaactgagatggcctgttcttgtgatcgctatactcgctgctgttgttggaagtcaagccatcatcaccggaacgttctccatcatcaaacagtgctctgcgttgggatgcttccctaaagtgaagattgttcatacgtcgtcgaaaatccacggtcagatatacatccctgagatcaactggctcttgatggtcctttgcttagctgtcaccatcggg

SEQ ID NO: 506 - DNA, 906 bp, Brassica napus
  misc_feature (881)..(883): n is a, c, g, or t
ccgcacagtctctcgtggtggatcattgttcttgctcaagttctgtatattaaggtgagtccaagatgtcgccggacttggaccgggtttagctggaaagcttttgatggtctttgggactttttccggttatcggcggcttctgccgtcatgctctgccttgagtcttggtacgctcagattcttgttctactcgctggacttctcaagaaccctgaactcgccttggattctctagctatctgcatgtcaatttctgctatctctttcatggtctccgttggattcaacgcagctgcaagcgtgagagttagtaatgaattaggagctggaaatccaagatcagcagcattttcaaccgcagtaactacaggagtgtcgtttttactatcactgtttgaagccgtactgatcctctcgtggcgcaatgtcatcagctacctttttacagacagcccagctgttgctgaagctgtagccgagctcactccttacttggctattaccatagttctcaatggagttcaacctgttttatctggcgttgccgttggatgtggatggcaagcatttgtggcgtacgttaacataggatgttattacattgtggggatccctattggttatgttcttggtttcacctatgacatgggagctaagggaatatggacaggaatgattgcgggtacgctcatgcaaactatcatcttactcattgtcactttccgaactgattgggataaagaggtggagaaggcttcaagacgattggaccagtgggaagatacacaagcgccgcttcttaagcagtaaacaaaaatgatatttttaaaaagaaaaattataytgggrggrtkkagaggrctacwrwarcgmtgtcnnnacaggaaaagccctttgcaggcc

SEQ ID NO: 507 - DNA, 1143 bp, Brassica napus
ggagagaagaagaagcacagcacacgcttcggagagaaacagaggaatacatctctwaaatggcgaccattagagtaccagacgaagttccatctccagctcaggattctgaaactctcaataaagcttttcgcggatggggaacagacgagaaggctatcatacgcgttttaggaaaaagaaacgagagccagagaaagagaatcagggagagttataaagagatttacggcaaagatcttatcgatgatctctcctctgaactctctggtgatttcaagaaagctgtgattctgtggacgaaagatccagcagagagagacgcaaggcttgcgaacaaggtcttgaatgacaaaaagaaaaccatagagaaactcaagatcctcgtggagatmtcttgcacaagttctcctaaccatttgattgctgtgaggaaagcttattgttctctctacgactcatcccttgaacaagacattgcttcctctgttccctttcctcttgcaaagttgctggtgacattagcaacttcgttcagatatgacaaagagaaggttgacaaggaagttgctacaatagaggcgggtatgctacatgaagccatatcaaaaaagcaactagatcatgatcatgtcctttacataataggaactcgcagtatctaccagctcagagcaacctttgttgcttacaagcagagttatgggaacacattagataaggatgttgatggatgtcctggagacgctgatctgagaagtctattgcagatggtgatcttgtgcattgagttccctgagaaacactttgcaaaggttgtaagagattcgattgaggggtttggaacagatgaagattcgttgacgagagcgattgtgatgcgtgcagagattgatttgatgaaagtaagaggagagtatttcaatatgtataacgcaagcatggataacgctatcattggtgatgtttctggtgactacaaggacttcctcatgactctacttggttccaaaatctgatctttgtttgaattttaatattcttggcttggcttgtgaattgtgacttgtatyaaaaacttcattttctgtttcagatttgataaaacatgttataaaaataatcaaaactactcttggtttt

SEQ ID NO: 508 - DNA, 1109 bp, Brassica napus
gcacgaggcttctatctcctgccacttaaaactgaattaacagaatgaacggtggtcatctccccaccgccgcttccgacgatctgaaatctcccctcttgccggttgtccataatgacgaaccattcgaaaaacaaacgctggggcaccatctccggacaatattcacacccaaaaactgttacatcgctcttggtcctcttctttgcgccgtcgtgtgtctatgcgcacggctcggcggagaagatacgacgactgcgaagaacatgctaggagttcttgtgtggatgttcgcgtggtggttgacggaagccgtcccgatgcccatcacctccctgtcgccgctttttttattcccactcttcggaatcacgacggctgatcatgtggcaagttcttacatggatgacgtcatttccctcgttcttgggagctttatcctcgctcttgccgtcgaacactacaacatccatcgccgacttgctctcaacataacgatggtattctgcgtggagcctctaaacgcgccgctgcttcttcttggcatctgcgcaacaacggcgttcgtgagcatgtggatgcacaacgtggcggccacggtcatgatgatgccagtcgctacagggatactccagagacttccctcgtcgccttcgtcgtcatctgaaatggtgcctccagcggtggggaagttttgccgagcggtggtgctcggtgtgatatactcagckgtygttggtggaatgagcacrctgacaggaacaggsgtsaatctgatacttgtcggaatgtggaaaagctayttcccggaggctgatccaatcagtttcagccaatggttcttcttcggtttcccgctagctttgtccttattcgtggtgctttggggtattttatgtgtactgtattgtcctaaaggaacagggaaagttctctctccttatcttcataagtcccatcttcgtacagagcttgagatgttgggaccaatgagtttcgctgagaagatggttttatctgtgtttggtggtttggttgtgttatggatgacaagaaacataaccgacgatatccccggctggggttgtatcttcaacggccgagccggt

SEQ ID NO: 509 - DNA, 1942 bp, Brassica napus
ccgggctgaggattcggacgagtttctctctctctcttgcgattcgttacgctgcttttgaatcgagatggatgaagatttcgagatgcctcccgtcggcggaatgaacggcgacgacgagatggacttcggcgacgacgcctccttcctcaaagtcggcgaggagaaggagatccagcaaggcttgaagaagaagctcctcaaggaaggcgaaggattcgagactcctgagaacggcgatgaagtcgaagtgcactacactggtacgttgctcgatgggaccaagttcgattcaagccgtgacagaggaacgcctttcaaattcactctcggtcaaggtcaggttattaaaggatgggatattggtattaagactatgaagaaaggtgaaaacgctgttttcactatcccttccgagctggcttatggggaatctggttcgccgccgaccattcctgctaatgccacgcttcagtttgatgtggagttgctttcttggtcgagtgtcaaggatatatgcaaggatggtggcgtttttaagaagattgttgctgcgggggagaagtgggaaatgcctaaggatctcgatgaagttcttgttaagtatgtggctaagcttgaggatggtacggttgttggaaaatctgatggtgttgagttcacggttaaagacggttacttctgccctgcacttgctaaggctgtgaaaaccatgaagaaggcagagaaggttcttctgactgttaaaccacaatatggtttcggggagaagggcaagccagcctctggtggtgaagctgcggttcctccaaacgcaacccttgagatcgagctggagttagtttcctggaagacagtttctgaagtgaccgatgacaacaaggtcatcaagaaaatcttgaaagaaggggaaggatatgagcgtcccaatgagggggcggttgtgaaagtgaaactgatagggaaacttggagatggtactgtgttcctaaagaaaggtcacggtgaaggtgaagagccctttgagttcaaaacagatgaagagcaagtgatcgatgggcttgataaagctctgttgaagatgaagaagggtgaagtggcattggtgaccatagacccagtgtatgcttttggttcaactgagtcaaagcaggaattagctgtggtgccgccaaactcaaccgtctattatgaggttgaccttgtgtctttcgacaaggaaagggaatcgtgggacatgaacactgaggagaagattgaagctgctggtaagaagaaggaagaaggaaatgccaagttcaaagcaggcaaatacgcactcgcttccaagagatacgagaaggctgtcaaatacattgaatacgactcatccttcagcgaggatgagaagaagcaagcaaaagcattgaaagtggcgtgcaatctgaacgatgcagcttgcaaactgaagttgaaagaatacaggcaagctgaaaagctatgcacaaaggtgctagagctggaaagcaccaatgtgaaggccctatacaggagagcgcaggcttacatggagttggctgatttggacttggctgagtttgatgtcaagaaggcccttgaagttgatcccgacaacagggaagtgaaggtggagcagagaaggctgaaggagaaaatgaaggagtttaacaaaaaggaggccaagttttacggaaacatgtttgcaaaactctctaagtgaagcagcagcatcgtggagaatggttcactggctttggatgtttttctcttttctgtacctttgcctaatttcgatcaagttgtgtttttttagataagactcctcaagacattgttgttctttattaaatgttagcgtttgataatttataatcgagattctcgtcataccttgtgtgaatcgattagaattcatcaagcaaatttttacatgttgtttcct

SEQ ID NO: 510 - DNA, 2200 bp, Brassica napus
ggacagacacacacacacacaagagatagagagagagagagagactatcatctttcccaaatttcgatttattattttctcgaatattccagcaaaaaaataaagaaataatgaattcagaatcgttagaaaatctccaccgaccactgattgaatcatcgaaatcgttcatcgactaccggctcgagactgtcttaaccgaccgagaactgccgtacctccgccggatctacctggcgatgatgatagagatgaagttcctcttccaccttgccgctccggcgatcttcgtctacgtcatcaacaacggaatgtccattctcactcgtatcttcgccggccacgtaggcagctcccaactagcagccgcttcactcggaaacagtggtttcaacatgttcacttatggacttctgctcggtatgggaagtgcggtggagacgttatgtggacaagcgcatggagctcatcgttacgagatgctcggcgtttacctccaaagatcaacggtggttctcatcatcacctgtctcccgatgtcgctcctcttcatcttctcsaagcctctcctcaacacactcggcgagccagaacaagtcgcgtcaatggcttccgtcttcgtctacggcatgatcccagtgatattcgcctacgcagttaacttccccatccagaagttcctccaagctcagagcatcgtcacgccgagcgcttacatctccgcmgckactctggtcatccaccttgtcctctcatggatcgctgtgtatcgactagggtttggtctcttggctttgtctttgatccatagcttgtcgtggtggatcatcgtcgcggctcagattgtttacatcaagatgagtccgaaatgtcgccggacgtgggaaggttttagctggaaagcttttgaaggtctttgggactttttccggttatcggcggcttcagcggtgatgctctgcctagagtcgtggtactctcagattcttgttttactcgccggacttctcaagaaccctgagcttgctttggattctttagctatatgcatgtcaatttctgcaatctcgttcatggtctccgttggattcaacgcagctgcaagtgtgagagtaagcaatgagttaggagctggaaacccaagagcggctgcgttttcaacgtttgtaacgacaggagtatcattattgctagcggtttttgaagccgttgtggtcatgtcgtggcgaaatgtcatcagctatgcgtttactgatagtcctgaggtggccgaggccgttgcggatttatctccctttttagccatcaccattgtcctcaatggagttcagcctgttttgtcaggtgtggctgttgggtgtggatggcaagcatttgtggcgtacgttaacattggttgttactacgttgtgggaattccgattgggttcgtacttggtttcacctatgacatgggagcaaagggaatatggacagggatgattggtggcacattaatgcaaaccataatcctagtgattgttacctttagaactgattgggataaagaggtggagaaagcttcgagccgactggaccaatgggaagagagccgtgagccgcttctgaaacagtaaacaatggacaatatttttgagagagaatcacatgaaagatggcaatttaattgatagaaaacatattttttcaatcgaaaaatgtatgttgttttgttgattaatgactcggaaatttatttatttattcctggaaaaggtgggagaggacagaaaattgtaaccagtatttcggtgtgagagtgaatatatgtatttttttcttaaagagaatgacttttttcaccaatttcmaaaaaaaaaaaaaaaaaaaaaaaaaaaaaaaaaaaaaaaaaaaaaaaaaaaaaaaaaaaaaaaaaaaaaaaaaaaaaaaagggggacaaaaaaaaaaaaaacaaaaaccaaaaacgcgaaaagagggaggcgcgaactcaccaaagaaacaaccaaaaacaaaaggggggggcccccttaagagacacactttttgggcgggcggggggagacccaatctttttttgagggcgccaaaacttttacgcgggcggctttttacaacacggggggggaaaaccccttgggaacccaaaaaaactctgagggaaaagcccccttcccggacggggaaataaaaaaagcccccc

SEQ ID NO: 511 - DNA, 1690 bp, Brassica napus
agacacaaagtcacaaacaaagaagagagagagagagagagagagaaacaccatcatcgttcccagattccgatttttactacttggatatactttcgatactctcgaagattccggtaaaaatgaactcagaatcgttggaaaatctccaccgttcattcattgaatcgtcgaaatcgttcatcgactaccgactcgaaactgtgttaaccgaccgagaactgccgtatctccgccgtatttacctggcgttgatgatagagatgaagttcctcttctacctcgccgctccggctatcttggtctacgtcatcaacaacgggatgtcgattctcactcgtatcttcgccgggcacgtcggtagcaccgaactcgccgccgcttcccttggtaacagtggattcaatctgttcacctacggtcttctgcttggtatgggaagtgcggtggagacgttatgtggacaagcgcacggagctcatcgttacgatatgctcggtgtttacctccagagatcaacggtggttctgatcttgacgtgtcttccgatgtcgcttctcttcatcttctccaaaccgcttctaagcacactgggcgagccggagcaagtcgcaacaatggcttccgtcttcgtctacggtatgctcccggtgatattcgcttatgcagttaacttcccgatccagaagttcctccaagcgcagagcatcgtcacgccgagcgcttacatctcagccgcggctctcgttatccaccttgtcctctcgtgggtcgctgtgtatcgcttagggttcggtctcttggctttgtctctgattcatagcttctcgtggtggatcatcgtcgcggcccagattgtttacattaagatgagcccaagatgtcgacgaagttgggaaggttttagctgaaagctttgaagtctttgggacttttccggctatccgcagcttccgcagtgatgctctgccttgagtcgtggtactctcagattcttgttttactcgccggacttctcaagaacccggagattgctttggattctctcgctatatggtaagtactttccttttttatttgtgcaacatggtaagtactttcaaaactctaatcttagtaaaaataattcttatttcttacctttttgaaacgtagcaacaaccarcaacataaattgcaaacaagagaaaattaattgaaaatctgctttttttttgtcaacattgaaaatctgctttaaactcatatctttatcatactgtatttgttttcatatttattatacattagttatgaatcttgaacatatatcaaatattttgctgcattaatgttagccaaaagtaattatagcaaaaagtaatttttcattctatttctaaataatagtttttttagtttttatacatatwaagaaagcatatttagttttgattatagatgtgttattctgttattcactattttaataactttwaatcmatamtatataataaattaaattattatcagtttcttaaactagcattattaatgaataaattttataaacctcaaaatttatttctgaatatattttttaacatacttttaggggtagcatttagcaatactagcttttgaactgctgctgaatccatgggcaggcaagagacaacctggcgaactgaaacatcttagtagccagagg

SEQ ID NO: 512 - DNA, 703 bp, Brassica napus
gataccaagtaaaagtaacaccgcgcgatcgaaaccaaaaaataaagttgtagcgagaaagaatcaacatggcgagtttactagataaagcaaaagatttcgtggctgataaactcgccggggttcctaaaccggagggttcggttacggacgtcgaccttaaagacgtgaaccgtgactccgtcgagtacttagccaaagtttcagtcaccaatccttacggtcacgcaattccgatctgcgagatcaatttcactattcacagcggtggccgggaaattggaaaggggaagataccggaccctggttcactgaaagcaaaggacatgacggttcttgatgttccgatcgtggtgccgtatagtatactgttcaacttggctcgagacgttggtgcggactgggacattgactatttgctcgaaataggtctcaccattgatcttcctgttgtcggggattttactattccggttaccagcaagggcgaaatcaaactccctacttttaaagactacttctgagtcaactttacgctgttaaaaacaaaacaaaaacaaatatcgtttgtactagtgatcaaatataataactaataagtgtggtttgcctataaaatcattaaatgtctttttcaatgtatgtgtttattcatacagttaataaatcaaagtttaaaactaataaatgaaaatttggaagc

SEQ ID NO: 513 - DNA, 1036 bp, Brassica napus
ctcttctcttgcgattcgtttactttcgtgctttttgaatcgagatggatgaagatttcgagatgcctcccgtcggtggaatgaacggcgacgacgagatggatttcggcgacgacgcctccttcctcaaagtcggcgaggagaaggagatccagcaaggcttgaagaagaagctcctcaaggaaggcgaaggattcgagactccggagaacggcgatgaagtcgaagtgcactacactggtactttgctcgatgggaccaagttcgattccagccgcgaccgaggaacgcctttcaaattcactctcggtcaaggtcaggttattaaaggatgggatattggtattaagactatgaagaaaggcgaaaacgctgttttcactatcccttccgagctggcttatggggaatctggctcgccgccgaccatccctgccaatgccacgcttcagtttgatgtggagttgctttcttggtctagtgtcaaggacatatgcaaagatggtggtgtgtttaagaagattgttgctgcgggagagaagtgggaaaccccaaaggatctcgatgaagttcttgttaagtatgtggctaagctcgaggatggtactgttgttgggaaatctgatggtgttgagttcactgttaaagacggttacttctgtcctgcacttgctaaggctgtgaaaaccatgaagaaggcagagaaggttcttctgactgttaaaccacaatatggtttcggggagaagggcaagccagcctctgctggtgaagctgcggttcctccaaacgcgacgcttgagatcgagctggagttagtttcctggaagacagtttctgaagtgaccgatgacaacaaggtcatcaagaaaatcttgaaagaaggggaaggatatgagcgtcccaatgagggggcggttgtgaaagtgaaactgataggtaaacttggagatggtactgtgttcctaaagaaaggtcacggtgaaggtgaagagccctttgagttcaaaacagatgaagagcaagtgatcgatgg

SEQ ID NO: 514 - DNA, 890 bp, Brassica napus
gatacacacactttctttacacagcaacatacactttcagaaaaagctttatataattatcatttcatatttcacacctttgaagaaaagaaaatggcgtctaaccaacaaagctacaaagctggtgaaaccagaggcaagactcaggagaagacaggacaagctatgggagcaatgagggacaaggctgaggaaggcaagaacaagacttcccaagcggcccaaacagcccaacaaaaggcccatgagacggcacagtctgcaaaagacaagacatctcaaactgcccaaacgacccaatcagcaaaagacaagacatcccaagctgctcagacgacccaagacaaagcccgtgagacaaaggacaagacggggagctacatgtccgaggcaggagaagccataaagaacaaggctcaagacgctgctcagtacacaaaggagacggctaaaggcgcggctcagtacacgaaagagactgctgaagccgatagagacaagaccggtgggttcttaagccagactggtgagcatgtgaagcagatagctatgggtgcagctgatgccgtgaagcacacttttgggatggctaccgaggaagatgacagggaaaattttccaggcacaactactggtactactaggaccactgatacgactcatcagacttatcaggggaagtgaggataacaagagaactatgtctgtgtcttccttttgtttctgtaataccgcctatttggtcttttgagtttctgttgtcttctgtgtttgtggttctgttttgtttctttagttgtgacggtgatcctggagacatctaatttcaagccaataagtttagaatgtgatcctgtcacaccttttgtttaagttcactttgtattttt

SEQ ID NO: 515 - DNA, 802 bp, Brassica napus
gaaagatatctttgatggttcaccctgacaaatgcaagcatcctcaagcacaggaggcttttggagcattggcaaaggcgcaacagctactgctaaacgaccaagaaagagattatattctcactcaagtccatgctgccaaacaagagcttaagatgaagagaaagaaacagttgaagaaagataccgcctctaaaataaagtccttggttgatgagggaaagcatgagcaactatatgagcaatctgaagagtttcagaaggagcttaagttaaaggtccgagagatattaacagaccaagagtggcgtaggcgaaaaatggctatgaggatatcagaagaagaggggagactgaagaaggatgaagaagagcaaaaggagatacggaagaaaaagcgtgagcatgaagaacagtgggaaggaacgagagaaaacagggtatcaagctggagagacttcatgaaagcaggaaagaaggccaaaaagggggagactcgtcctccgaaattgaagaccgaggatccaaacaaatcatacgtccaaaggccggtcaagaaaggctgatctctgtcttattttactgttgttgccattgatagattggtcatctcgagtatgatctcagacttgttctgctcatgtctttgttttctctttgtacatcaccaacttctctgtctttccaaattcatcagaaacatggatgagataaatttaactcacttctcaaacgcttttgaccttttaacttatgtattgtgttagactttatatagtacactttgatcttttttatattt

SEQ ID NO: 516 - DNA, 1615 bp, Brassica napus
ttgttctgcgacttcttctgttgttgyttcycatcgtaattgwcgttrrtmckytttywmwytcggaarmctckrwakckmtkcysawtmgkyratktkgatttgkatwkgaaccatggggaggaagtctcagcgtaagaaygtccccatggatttgtttgatagtgatgatgatacaagtagtattagctcytcctccaccatscgttctgagagacccggcatggatgawgttcaggttcacaaagatttgatgctsgatcaatcccttgatgctctctatgagaraaggacttcrackagagagcaagctttggcctccattgttgatgctttcaacagcgacttgcagcatgagtttgtcgaaaagaagtttgccacattattgcatcagtgcttacactgcaccaagaaagggtccagcaaggagacctctttagcatcacatgttattgggttgctagcattgactgttggacttggggatcaagcacaagagattcttgaagaatccgtcactcctctttctcaggcccttaaatctggtcgtgaagtgttaaaaataacttcgattcttgagtgtttggcagttataacctttgttggtgggaccaatccggagcaaactgagacatctatgcaaataatatggcaaatgattcaccccaaactaggttctaatgttgttgcaaccaraccttcacctgctgtgataactactgttgtctcttcctgggcgtttctgctcacaacagttgaccgatggaccctaagtcccaaactttggcaagagatcgttacttatctctcctcactgttggaaaaagatgaccgatctgtacgtatagctgctggtgaagcgcttgctctgatatttgagtcgggaactctggagaagtttgctgctgaagccaaagagtctgctaataatggatcagtgaaagaaggaagtgtgtctcaggaggcattgattcacatgcatggcctgaaatccaaagtcgttaaccaagttagagacctctctgtagaggcaggtggtaaaggctctgctaagaaagatctcaacacacaacggaatttgtttaaagatcttgttgaatttcttgaggatggatacgcacctgaaacctctacaaaggttggaggggactatttgcagacgtcaacttggtatcagatgatacagttgaattttttgaagcatttccttgggggtggctttatcaagcatatgcaggagaatgagttccttcacgatgtattcaacttcactccaaaaaaggttggtgggcgaggttctggcatgtctagtgaagaaaagaggttgtttaaatcaccaaactcagctctcaacaaagcaaggacgcaattcctgaacaagcagaggatgctagctaagaacatgaacgatgggcattatgcggcgacggtggagaacgaatgatggcttctcactattgattttaaagctatgcaaacttgcctgctgccttgttgacgattgatgtaccatagaatcacttttgctgtttcatcattatacttttatgtcacttttaccgtcagaatgttattactctgacaatacagttgttgctcttagagagccattgaa

SEQ ID NO: 517 - DNA, 1173 bp, Brassica napus
tttcctaagcgtgctatagtgcttggaggagggtacattgctgtggagtttgcatcaatttggcgtggaatgggtgctactgtagatttattcttcagaaaggaacttccactaaggggctttgatgacgagatgagggcactkgtggctagraatctwgaaggaaggggtatcaatctgcatccacaaacaagtttggctgagttgataaaaacagacgacgggataaaagtaatctcctctcatggggaagaattcgtggcagatgttgtactatttgctactggaaggattcctaataccaagagactgaatttagaagctgttggtgttgaacttgatcaagctggagctgtgaaggttgatgagtactcacgcactaacatacctagcatatgggctgtgggagatgctacaaaccgaattaaccttacacctgttgcgttaatggaggccacctgctttgcgaacactgtctttggtgggaagcctactaaagcagactacaccaatgtagcttgtgctgtattttgcataccaccactagctgtggtgggtctcagcgaagaagaggcagtagaaaaagcgaccggggatattttggttttcacctctggcttcaaccctatgaagaacaccatttctggacggcaggaaaagacattaatgaagcttatagttgatgagaagactgataaggttattggagcatccatgtgcggtccagatgcagctgagatcatgcaggggattgcaattgcgctcaagtgtggagcaaccaaagcacagtttgacagcacggttgggatacatccatcttctgcagaggaattcgtgacaatgcgcactgtgaccagatgcattgcctacaaagccaaacctcaaacgagtctatgaaccgccaaaattaaatagactatttgcattgaacacgttagtttggtcggagggtcagaccgaaacatttgtttcgtcatactcatgttcaaataaatgttttgtataagtttttgtttgtttgtttatcaccaaacatgcattatctttggataaaattcacactcttttggtcatatagtgtacttcaatttgtttggtaagttttgtttcaatggtgtatttaattggacaaggttatttagattaagagatataagaccaagttcaagctac

SEQ ID NO: 518 - DNA, 1752 bp, Ricinus communis
atggaagaggattttgatattccagccggggatgaaatgatgatgaacgatgacgtggatctcggtgatcaaagccccattttgaaggtaggcgaagagaaagagatcgggaagcaagggttgaagaaaaagcttgttaaagaaggtgaaggatgggatactcctgataacggcgacgaagttgaagttcattatacggggacgttgctggatgggactcaatttgattctagtcgtgatagagggacgcctttcaagttcactcttgggcaaggccaagtgattaaaggatgggaccaaggtatcaagacaatgaagaaaggtgaaaatgctattttcaccattcctcctgagttggcttatggtgcttcaggctcaccaccaactattcctcctaatgctacccttcagttcgatgttgaattgctgtcttggactagtgtcaaggatatctgcaaggacggtggcatatttaaaaaaattcttgttgaaggagaaaaatgggagaatccaaaggacctcgatgaagtattagttaactttgaagctcagcttgaggatggcacagttgttgccaagtctgatggagtggagttcgctgtcaaggagggccatttctgtcctgcactggcaaaggctgtcaagacaatgaaaaagaaagagaaggttcttcttacagtgaagccacaatatggatttggggagaagggtaagccagcatccaatggtgaaggtgctgttccacccaatgccacacttcagataactctggagctggtttcatggaagactgtatcagaggtgactgatgacaagaaggttatgaagaaaatactgaaggagggcgagggatatgagcgtccaaatgatgggtctcttgtcaaattaaagttgattgggaagttgcaagatggtacagtattcttgaagaagggccatgataatgaggaagagctgtttgaattcacaacagatgaggagcaagttattgaggggcttgatagagctgtgctagcaatgaagaagggtgaggtggcactagtgacaattgcaccagagtatgcatttggtgcatctgagtcaaagcaggagttagctgttattcctcctaactcgaccgtatattatgaggttgagctggtatcctttgtcaaagagaaggaatcatgggacatgaacacccaggaaaagattgaagctgcaggtaagaagaaggaagaaggcaatattctgttcaaggcaggcaaatatgctcgggcttccaagcgatatgagaaggctgtcaaacacatagagtatgattcttcttttagtgaggaggagaaaaaacaggccaaggcattaaaggttgcttgtaacctaaataatgctgcttgcaagctaagattgaaggagtacaaagaggcagaaaagttgtgcactaaagtgttggacttggagagtagaaatgtaaaggctctatacaggagagcccaggcatatattcaattggcagatttagatctggccgagtttgatattaaaaaggcccttgagattgagcctgataacagggatgtcaagctagagtatagaactttgaaagacaaaatgagggagcttaacaagaaagaagccaaattctatggtaacatgtttgccaaaatgaataagctgggtcctctagactccaacgtaagtatccttgcctgttttagctggaattattggtgggtggtttatgcgtcttgcacagttatattgatatgctga

SEQ ID NO: 519 - DNA, 1328 bp, Ricinus communis
gtttgtttttctctctctatctctaaacattttctttttcctttttttttcttcttttttaacctaatattaaaatcccttgcttttcttgatccccgttctcaaaacgccctgctttccattcctttctcccgtcgattttctcgagaaagtgtttgggaggagggggaattgggattgatattataaaataataatcattccatattataaataattaaataaatagaaatgagttttcaagatctggaggccggacgtccgtttgcgggttcgaagatcaacggcaagaaagacgccacgcaaggtgtagtatctggaatcttccagataacaacttccgtttccacgtttcaacgtctcgttaatacccttggtactcctaaggacacccctgagctccgtgagaagctgcacaagacaaggctgcatattgggcagttggtgaaggatacttcagcaaaacttaaacaagcaagtgaaacagatcatcatgcaggagttagtcaaagcaaaaagattgctgatgctaaacttgcaaaagattttcaagcggttttgaaagaatttcaaaaggcgcaacggcttgcagctgagagagaaacagcatataccccttttgttccccaggcagtccttccctcgagctatacagccagtgagatagacataaattctgataagagtccagagcagcgtgctcttcttgtggaatcaagaagacaggaggtcttattattggataatgagattgcttttaatgaggcaatcattgatgaacgagagcagggaatacaagaaattcaccagcaaatcggtgaggtgaatgagattttcaaagatcttgctgtcctcgttcatgagcaaggagcaatgattgatgatattggctcccatattgaaaatgcccaagctgcaactgcacagggcaaaacacaccttgtgaaagcagcaaagacccaaagatctaattcgtctctgtcctgcttgttgttggtgattttcggaattgtgcttctcattgttattgtagtacttgcagcataagttcaaggttatcttgattcaattattaaccatttccaagagctagtgggggaacaagatagggatctatttactagttaatttagttaatggtcttccaagaggatatgtgacttgctggtgtgtctcactgctgatcagagggtggtatatatatattgtttggtatttgaataggatgacgttcagttattatattttgctggtatgtatttcgctgtctgggtttttgagggtgttgtgtaattgttctttttctgtttcttatagtaataagttat

SEQ ID NO: 520 - DNA, 1725 bp, Ricinus communis
atggaagaggattttgatattccagccggggatgaaatgatgatgaacgatgacgtggatctcggtgatcaaagccccattttgaaggtaggcgaagagaaagagatcgggaagcaagggttgaagaaaaagcttgttaaagaaggtgaaggatgggatactcctgataacggcgacgaagttgaagttcattatacggggacgttgctggatgggactcaatttgattctagtcgtgatagagggacgcctttcaagttcactcttgggcaaggccaagtgattaaaggatgggaccaaggtatcaagacaatgaagaaaggtgaaaatgctattttcaccattcctcctgagttggcttatggtgcttcaggctcaccaccaactattcctcctaatgctacccttcagttcgatgttgaattgctgtcttggactagtgtcaaggatatctgcaaggacggtggcatatttaaaaaaattcttgttgaaggagaaaaatgggagaatccaaaggacctcgatgaagtattagttaactttgaagctcagcttgaggatggcacagttgttgccaagtctgatggagtggagttcgctgtcaaggagggccatttctgtcctgcactggcaaaggctgtcaagacaatgaaaaagaaagagaaggttcttcttacagtgaagccacaatatggatttggggagaagggtaagccagcatccaatggtgaaggtgctgttccacccaatgccacacttcagataactctggagctggtttcatggaagactgtatcagaggtgactgatgacaagaaggttatgaagaaaatactgaaggagggcgagggatatgagcgtccaaatgatgggtctcttgtcaaattaaagttgattgggaagttgcaagatggtacagtattcttgaagaagggccatgataatgaggaagagctgtttgaattcacaacagatgaggagcaagttattgaggggcttgatagagctgtgctagcaatgaagaagggtgaggtggcactagtgacaattgcaccagagtatgcatttggtgcatctgagtcaaagcaggagttagctgttattcctcctaactcgaccgtatattatgaggttgagctggtatcctttgtcaaagagaaggaatcatgggacatgaacacccaggaaaagattgaagctgcaggtaagaagaaggaagaaggcaatattctgttcaaggcaggcaaatatgctcgggcttccaagcgatatgagaaggctgtcaaacacatagagtatgattcttcttttagtgaggaggagaaaaaacaggccaaggcattaaaggttgcttgtaacctaaataatgctgcttgcaagctaagattgaaggagtacaaagaggcagaaaagttgtgcactaaagtgttggacttggagagtagaaatgtaaaggctctatacaggagagcccaggcatatattcaattggcagatttagatctggccgagtttgatattaaaaaggcccttgagattgagcctgataacagggatgtcaagctagagtatagaactttgaaagacaaaatgagggagcttaacaagaaagaagccaaattctatggtaacatgtttgccaaaatgaataagctgggtcctctagactccaacaattctaaatcaaatgaagcagggcaaatgagcatagacagcaaggcatga

SEQ ID NO: 521 - DNA, 968 bp, Ricinus communis
atgggagacagaacatcacccacaaccacagacgacgatttgcttctcaaaagcttcttcgctgaagttagcgaagtcgagagagacaacgaagttgccaggattctttcatgcttcaagttgaatccatttgagtatctaaatctaccatttgatgcatctctagaggatgtgaagaagcaatatcgtaagttatctttgctggttcaccctgacaagtgcaagcatccacaagcaaaagatgcatttggtgcattggcaaaagcccagcagctactacttgatcaacaagaaagagattatcttcttagccaagttgttgcagcgaaagaagaacttctagcaaagaggaagaagcagttgaagaaagatacagcctctaaaataaagtcattggttgatgagggaaaatatgatcaactgtatgaaaggtccgaggagtttcagcgggagctcaaattaaaggttcgagaactattaactgaacaagaatggcgcaggaggaaaatgcaaatgaggatatcagaagaggaaggtagactaaagaaggatgaagaagaacaaaaagagatttggaagagaaagcgtgaacatgaggagcaatgggaaggaacaagagaacaaagggtttcaagctggagagatttcatgaagactgggaaaaagggtaaaaagggcgaaattcgaccaccaaaactaaagactgaggaccctaacaaatcttatgttcaaaggcctgtaaagagagcttaatcatattgttttggtctcttgagggctatgacattggcaaccgagtgttccttattcaaagaaggcttggcgtgcagctttcaaattgtactagtatatgtcctggactcttggtagtaaaaggactaatacatttgacaagggacttggttctttttcttgtgccatgtttagtgaattaaagcagatatataatgtatttactgatgtgtttt

SEQ ID NO: 522 - DNA, 1618 bp, Ricinus communis
cttcggtttggtcttctttatacggagtgtgaagtatgaagtgtcaaagctgaaacataacacaaattaagaaagctccaaaacccgaatcctctaattaacttataatttctgtttagaatcaatcatggcaaggaagatgcttattgatggggagctgaatcaatcaaatgagcaagaggcacaatttgattttgatttgtttgtaataggagctggaagtggcggtgttcgtgcttctagattttctgccaattatggagctaaggttgggatttgtgaacttccttttaatccaatcagttcagattcagatggaggagttggtggaacttgtgttcttcgtggttgtgttcctaagaaaatcttagtgtatggagcgtcttttggaggtgacatcgaggatgccaggaactttggttgggacataaatgaaaaagtggaatttaactggaaaaagctgttgcagaagaagactgatgagattaccagattaaatggcatttacaagcggttactgtctaattctggggttaaactttttgaaggagagggaaagattgttggtccgaatgaagttgagctgacacagctggatggcaccaaattgagctactcagcaaagcacatattgatagcaactggaagtagagcacagcgtcctgctattcctgggcatgagctggctataacctctgatgaggcattgagtctggaagatatgcctaagcgtgctgtggtgcttggtggagggtacattgctgtcgagtttgcttcaatatggcgtggtatgggtgctactgttgacctcgttttcagaaaggagcttccattaagaggttttgatgatgaaatgagggcagtggttgctagaaatctggaaggccggggaatcaatttgcatcccaggaccaatttgacacagttgacgaaaactgagaatggcataaaagttcttacagatcatggagaagagttcatggcagatgttgtgctctttgccaccggtcgggcacctgttacaaagaggttaaatttggaagctgtaggtgtggagcttgaccatgcaggagctatcaaggtcgatgagtattcacgcaccaatatacctagtatatgggctattggtgatgtcacaaaccgaatgaatctcacccctgtagctttaatggagggaacgtgctttgcaaaaactgtctttggtggggaatcttgcaaaccagactataccaatgtaccatgtgctgtattttgcattcctcctatgtccgtagtaggcctcagtgaagagcaggcaatagagcaagcaaatggtgatatattggtcttcacgtcatcctttaatcctatgaagaatactatttcagcacggcaagagaagacagtgatgaagcttgttgtcgatgccgagacggataaagttcttggagtttctatgtgtgggccagatgctcctgaagttgtacagggaatggctgtcgcactgaaatgtggagcaacaaaggcccagtttgacagcacggtgggcattcacccttctgccgccgaagaatttgtgacaatgcgctcgctcaccaggcgtgttaatgccggtaacaaaccgaagacaaatctctga

SEQ ID NO: 523 - DNA, 3049 bp, Ricinus communis
agaaaggaaagtcagagaagagaagagaagagactatcttgagacattgaaaattggtgtaaatgaatctctatatccttatccatttcatcttatagaatcattacaagttgaaaacacatacaagttcttcaactcttgaattcttgattcttgattcttgaaagaaaagaaggaaaaaaaacaaagatagaatatggaaagtccaccagcagcagaagagctattaaagaagatccaagaattagaagcagggcaagcacatcttaaggaacagatgtccaagtttaaactaactagcgatccagtatcagacagccagctgcaccaccatcaccaccaccatcaccatcaccaccggcagcagcagcagcagcagcagcagcagaggtctcattccatttctccgcaaagaacggggactaggaggagtggaggtggtgctggtgctggtggctttgaggtagtcgcagcttggaagaaaggttcgacgtcgtttaggcattcgtccccgttacagcgtgaaagtcggagttcgagtgctgataaaattaatgctgccgttaaagaagaaggaggcaataagtgtgggccatcagctgttaagtttactgataaacagtatttgaatatattgcagtctatgggacagtctgttcatattttttatctctctggccgtatcatttattggaacagaaccgctgagaatctttatggctattcttccgcggaggctctcggtcaggatgccattgagttgcttgtggatcccagagattttgcggtggcgaataatatagtccatcgtgttgcaatgggggagagatggacggggcaatttccagttaaaaataagatgggagagagatttacagctgttgcaaccaacactcccttctacgatgatgatggcactttgattgggattatctgtgtgtcaggtgatgtgcgcccatttcaagaaacaagagttgcattgataggtccaaagaattcagaagctgattcaagttttagtcggccaagaagtactgttacaacaaaacttggacttgattctcaacagcctttgcaagcagtaatagcttctaaaataacaaatttggcatccagagtgagcaacaaagtaaagtcaaaaattcggacgggagataacatcatggatcgtgaaggtgggagtggtgatagtcatcaatctgatcatggcttttcagatgcagctctctctgaccacagggaagatgcaaactctagtggagctagcacacctagaggtgatatacatccatctcagtttggtacattttctcatgttgatgaaaagtccccgatgaaagccattcgagattctggatatgagagtgaaggaaaacctggaattcacaagattattacctcaaaagctgaggcttggattggtaaaaaagggctatcatggccctggaaagggattgaaagggaaggcccagatacaaagacctcccgttttgtgtggccctggttgcaaaatgatcaagagagtgaattgcttcatcaaaggagtccccctgctggtgcaaaacctgagagccagctgaatgagagtaatcggcctaccaataatgaggcctccggatcctggtcttcctcagtcaacgttaatagtacaagcagtgccagcagctgtggaagtaccagtagtagtgctattaataaggtggacatggacattgactgcttggattatgaaatattatgggaagacttgacaataggagaacaaattgggcaaggttcttgcggcactgtatatcatgccctgtggtatggatcagatgttgctgtcaaggtattctccaagcaagagtattcagatgatgtgatactcgcgtttagacaagaggtatctcttatgaaaaggcttcggcatcccaacgtattacttttcatgggtgctgtcacttcacctcaacgtctctgcattattacagagttccttccacgtggaagtttgtttcgcttgctccagagaaacacaacaaaattggactggagacgtcgcattcatatggcattagatatagtacgaggtatgaattatcttcatcattgcaatccacctattattcatcgggatttgaagtcttcaaatcttttggttgataagaattggactgtaaaggttggtgattttggtttatcccgtctaaagcacgaaacttatttgacaactaagaccgggaagggaacgcctcaatggatggcaccagaagttctacggaatgaaccatcagatgaaaagtctgatgtatacagctttggagtgatactgtgggagcttgccactgagaagatcccttgggataatctcaactcaatgcaggtgattggagctgtagggttcatgaaccaacggttggagatccccaaggatgtggatccactgtgggcttctataattgagagttgctggcacagtgatcctcagtgccgtcccacgttccaggaactgctggagaagctaagagatctgcaaagacaatacgcaattcaattccaagcagcccgttccgcagctggggataacacacaaaaggaattatagaccaaaagattctttagcttctggctttcattgatcgactcggcacagaaatagctttctcttttccttctcttgcaaatattttgtggcaattgctggtgaggaaacggttagcacagttgcccacagattgccactaaaagtttgtggtattggcatagaaaaactcacagcaagcagacaaagaaagggaaaaaagaaactgatgtagttggaatccacgtgagctgcctaaagtttgatggtgattggatggttttggtgtttatttactgacatcattaaaatcttcgaaatccatcatctacggtgctgtgattggacttgttacgctgtttgggttcaattccaccattaatgtgcgagagatttttaggaccactcagaaaagttgtacagcaaacacattttttaatcgataatatagattgagatataatatcttacttttatctttttaag

SEQ ID NO: 524 - DNA, 2095 bp, Ricinus communis
cctttctttgacttgttaagggtttcttttgcttttaaattttttttcttttccttttcaattctcatcaaatcaaacccacagcttctcattcattagtatttttgggtctgtttttctttgcaccgaaaattgcatgagccagtcttttccttttccagaagctttgaagaccccttatagctttaaggcattgaatgtggtaaaatggggtgtttcacagtcttgaagagcaagaagaaaaagcctgaaccttcagtttccatcaagcgtgttagtcctaaggagcaaacaccaaccacgctaccagaaccccagatcccaactcggtcattgcaatcagcaccccctagttttaggactagagtgaaacctgttcaaccagataacagattaattaacaatagagcacgggtaaagtcagctccagaaagccttgattctgcagagcaagatgatcttgcagcaattgaatatgatgagcatgaagagttgaagagcagagttagtttagcgagggaccacctgagcccacagcctcttcctcttcctgccgccgcactgaagcctgcaggtagcttgaaattcacaaatggcagtggccctctctatgcttctgggccattgccattgccaccaggtgtaacacagagtggaacattaaggaacttttcgtatgatgaaatcatatctgcttgccgcaatttctcttcagatcggtgtgtatctgaaggtctttcttcgattatataccgggcttcctttggggatgatacttcaagttcaaagaagttcgaagccactgttacacgtcttcattcctcccctcagggtttcaaggaatttataaatgaggttaatactcttgcatccttgcggcatccaaacctgtgtaaattgcttggttatcatgcacgtgatgggtcagagcagagaatgctgatctatgagaggctttatcatggaagcttggaccgccttttgtatgggagattagatggccctccaattgactggaataccagaatgaaaattgctttatgtgctgcacaaggtcttacttttttgcatgaagaggggcctttccaggcaatgtacaatgaattctctactggcaacatacagatcgataaagattttagcgcaaagctttcaggatatggttgtgttggtcatattcctgagacagagatctctaacagttcagtggctgtggctaatctctctgtggagacactggagagagggttgttgactccgaagagcaatgtatggagttttggaattgtgctgcttgagctacttaccggcaggaagaatcttgataatcgccatcccaaggaggagaggaatttagtaagatggagccggcctttcctagatgatgactgtagactgtcactgattatggatcctcagctaaaaggccgtttccctctgaaagcagcaaggacagtggccgatattgctcttagatgtcttaagaaggacccactggaaagaccaactatgagagccattgtagaaaatcttagagtcatacaagacatgaaatcctcaactcgattccctttgcaagaaccagctgcagttgctggaaaacagatgtctagatccccaagtctgaatgggatcattaccccagcacccaggttaagtttctcaccatccccaccgtcaagagcccgaccatctctttctcctacaaggccacctgctttgcccatctctcttcctccacgtgcctgttcgaccctctcattggacgaattggaacagcaagaaagccgaaagtcatcatcatcagctgttcgaaggcctagtgttgaaggattttgattgttaatatgtattttctcttttaaaattcttttccttttttggaatacccttttcgattccctttttgctgattcaatagaatatatagaaagataaaatgtggttcttccccttccaatccttcaagataaaagagaggatgttgttttgtagatagagtgcgaagcctggtccctcgaggctgattagtttctgtagtccacaatgccatttatatgatagtattctaaatccaccctttgcctagtatact

SEQ ID NO: 525 - DNA, 1914 bp, Ricinus communis
agacaacttgtctactagcttcttccctccatatagtaacagaaaaggaagcaaagtcataaacagaactcatcagcttccattttccatatcctgaatagccaattttctcaaacaaaaccaagaccaaaccctttcggtacaagatgaatacctccgatcccatctccgatgatccaaaaactccatttcttcctgtcagtgatccaataatccaacgccaggcaagctcccattcatcatctgtagcatcccagcttctcacaccaggcaacttctacatccttcttggaccacttctatgcacaattatttgcctgtcagtgaagcttgatgctccagcaactagccggaatatgttaggagttcttgcttggatgttctcttggtgggtaactgaggctgtgcctatgccaatcacttccatgacaccattgtttctgttccctctatttggaattgcttctgccgatcatgttgcaaaatcttttatggatgatgtgatttcccttgttcttggtagctttatcttggctcttgctgttgagcattacaatatacacaggagattggccttaaatataacgcaactgttctgtggggagccactgaacccgccactgctcctccttggcatatgcgcgacaacagcgtttgtcagcatgtggatgcacaatgtggcggcagcggtgatgatgatgccagtggccaccggcatcttacagaggctgccgccgaaccaaactcaaaacaatgagttgagaaacttcagcaaggcggtggtcctaggggttatatactctgcggctgttggggggatgagcacacttaccgggacaggtgtcaacctgatattggtcggcatgtggaagagttattttcctgaggcagatcccatcagtttcaacacttggttcttttttggattccctttggctttgattatcttctttgctctgtgggccatactttgcttgttgtattgctcaaggaggtcaagccgtgaactttctgcttatttggacaaagctcacctcaagagagaacttgaattgttaggtccaatggcttttgctgagaagatggttttagccatattcgggatgctaatagttctatggatgacaagaagcataacagatgacacgcctggctggggagctctcttcaaggggcgtgctggggatggcactgctagtgttttgatggcaacctttctgttcataatcccaaacaagaagcaaaagggtgagaaactgatggactggaacaaatgcaagaagctaccatggaacatagtgttactactgggagctggtttcgcaattgcagatggagtaaggactagtggccttgctgatgtgctatcaaaagccttagccttcttagaaggtgctccatactgggcaattgcaccagctgtatgcctcataagtgctacaatcactgagttcacatccaacaactcgacaaccactcttgtagtccctctgctgatccaaatagcaaagacaatgcgtgtccaccctctcttgctgatggttcccggagcaatcggagcccagtttgctttcttgcttccaactggaacgccttctaacattgttgggttcactacaggccatattgagattaaggatatgattaagactggtgtaccactcaagattgctggcatagcagcactctcttttataatgcctacactaggagcttatgtttttgggacaaacggaggagttcaaaagatgtagaagttgaggattgttgtatagataagtgtatacctgtgatcatcacctgcattccccaatggtttttttctttctgagaaaagagaaaaagaaaaattgctgacaacgtgaacacgacattgttggcatgatgataattgtatagataagtgtagaactt

SEQ ID NO: 526 - DNA, 886 bp, Ricinus communis
atgacgactgcagctcgaccgacatgggcacctgcaaaaggtggtaatgaacaaggcggtactagaatttttggtccgtctcagaagtactcgtcgagggaccttgccgctcatacaaatctaaagcctaggagggaagggcaagacacacaggatgaactgcagaaaaggaatctccgcgaagagcttgaagagcgtgaaaggagacatttctcatcaaaggataaatcttataatgatgatagagaccgtagaaagagtaatcaacttctcctggaaggtgcaaagagggacactgaagaccgcatcattccacgcagtgtagatgctgatgattctgatgtggaagttaacaatgacgatgagagtgatgatgaggatgatgacgatgatgaggatgacacagaagctcttatggctgagcttgaaagaattaagaaggaaagagctgaggagaagttacgacaggaacaacaagaagcagctgaagagcttaaagtcaaggaagagcagcttctcagagggaacccactgcttaacaacccaacatcttttaatgtgaaaaggaggtgggatgatgatgtggtcttcaagaaccaggcccgaggtgaaaccaaagcacccaagcgctttatcaacgacactatcaggaatgacttccaccgaaagttcctgcagaagtacatgaagtaattcgtttaatcataattgactcgagtctaaaagattaacgtggatttgagtctgctgtatgtattgaaagtaacaactatctcagctggtttgaaattttcatttgtttttaatccctactagggttttgtgatggtttccttacatcgatacatttgaggaactgtttcgcaatgaaaaaaacttatcatcg

SEQ ID NO: 527 - DNA, 2349 bp, Ricinus communis
tcttttgaaaatagtaatcgtcttcataattacattctctggacttgcttgaaataaattagaaagaagctccttttgagcttttctgttagaattcctatcggggtttctaagtttttcctagttttattcaatcaataatcttgattaatgaaatttgtcttttctagctttgtttttacatcaagtcttaatctgtaagattccagttctattatttataccaattgactgtctcgctatcgtttttttcgaggcagacggctatttagattgaaactctgatcagaagagagaattggattagtattaaaaatgagggaaaagttagggttcttaggatttgtgttacttatgctgtgtgggtcttgtttgggtaggtttgtagttgagaaaaacagcttaagagtgacttctccagattcagtgaagggtatacatgaatgtgcaattgggaattttggtgttcctcaatatggaggtactttggttgggactgttgtttatccaaaagctaatcagaaagcttgcaaaggatttgatgaggttgatatctctttcaaatctaagcctggaggtttacccacttttcttctcgctgatcgaggagattgttacttcacattgaaggcttggaatgcacaaaatggtggagcagcagctattctggttgcagatgacaagttggagccgttgattaccatggacacccctgaagaagaaaatgcagatgctgactatttgcaaaagatcaacattccatcggcccttatcaccaagtccttgggagacagtatcaagaaggctctatctggtggggagatggtgaacataaatcttgattggactgaggcccttccacatcctgatgagcgtgtcgagtatgagttctggacaaatagcaatgatgaatgcgggccaaagtgtgacagccagatggacttcgtcaagaacttcaaaggtgcagctcagatacttgagcagaagggttacactcagttcactccacactatataacatggtattgcccagaagcattcattctgagcaaacaatgcaagtctcagtgcataaaccacggcaggtactgtgctcctgatcctgagcaggattttagcaagggatatgatggaaaggatgttgtggttcaaaatctacgtcaagcttgcttttttaaagtggccaatgaaagtggaaaaccatggctttggtgggattatgtgactgactttgcaatccgttgtccaatgaaagataagaaatacaccaaagagtgtgcagatcaagttatccaatcacttggtgttgatatcagaaagatagacaaatgcataggtgacactgaagcagatgtggacaacccagttctcaaagctgaacaagatgcacagattggaaaaggttctcgaggagatgtgactatactgccaactctcgtcgtaaacaataggcaatatcgaggtaagttggataagggggcggttctcaaggccatttgtgcaggtttccaggagaccactgagccagccatatgtttaagtgaagatgtagaaaccaatgagtgcttggagaataacggtggatgctggcaggacaaggctggaaaccttactgcatgcaaggatactttccgaggtagagtatgtgaatgtccagtggtacgaggtgtgaagtttgttggtgatggttatactcattgtgaagcttcaggttctttgcgttgtgaaattaacaatgggggatgttggaagaaaacccaagatggcaggactttttctgcttgtgttgaggatcattcacaaggttgcaagtgtcctccaggattcaagggtgatggagtcaattcctgcgaggatgtcgatgaatgcaaagagaagtcagcttgccagtgtccagaatgcaaatgcaaaaatacatggggtggttatgattgtagctgtagcagtggtttattgtatattcaagaacacgacacatgcataagtaaggctgctaatacagaggttggatggagctttatttggattattattctagcattggctgccgctggagttgctggatatgcaacttacaagtacagaatccggaggtacatggattcagagattcgggcgatcatggcacagtacatgccactggataatcaaggagagatccctgtccaccatgctgcccggggcgacatctgaaggatgagattgggaggttcatattttcagctgcgctttagcagcatttaattggtctctacaagggtgcgtatatggtctggcgtcctttttgagcagtctctcacactctttgtaaaatttaactgcttagtaagttagataagtggcgcacat

SEQ ID NO: 528 - DNA, 2289 bp, Ricinus communis
agagattcgtggaagacagtgttaactttggcatatcagagtttaggtgttgtttatggagatttaagtacttctccattatatgtgtataaaagcgcttttgcagaggatatacagcattcggagaccaatgaggagatttatggagttttatccttcgtattttggacattgacactaatcccattagttaaatatgtttttattgtgctcagagctgatgataatggtgaaggtggtacttttgctttgtattcgttactttgccgccatgcccgggttagttccatacccaattgccagcttgctgacgaggagctatcagagtacaaaaaagatgggtctgttttcaatgataaaagtggtattgggtctagtttgaaatcaactttggagaagtgtagaatattgcaaaggctgttgcttgttttggctttgattgggacctgtatggtcattggggatggagtgcttacaccggcaatttctgtattttctgctgtgtcagggctggaactatccatgtcgaaagagcagcatcagtatgttgagctgccagttgcttgtgcaatacttgtattcttattttccctccaacattatgggacccaccgggtaggattcctctttgcgccggtcgtgattacatggctgttatgcataagtgctattggtgtgtacaatattttgcactggaatccccatgtttaccaagcactctccccatactacatgtacaaatttttgaagaagacccagaggggaggttggatgtcattaggtggaatcctgttgtgtataacaggctcagaagctatgtttgcagatcttggtcacttttcacagttgtcaattaagattgctttcacctttgtggtttacccctcattgatactggcatatatggggcaagctgcttatctttctaagcatcatattattgaaagcgactaccggatcggtttctatgtatctgtacctgagaaaataagatggcctgttctggcaatagctattcttgctgcagtggtaggaagtcaagccatcattactggaacattttcaattatcaaacagtgctcgtcacttggttgctttccaaaggtcaaaattgtgcacacctcatcaaaaatgcatggccagatttacattccagagatcaactggacattaatgctgctatgtctggctgtcactgttggttttagaaacacaaaacacatgggaaatgcatcaggtttggcagttataactgtaatgctggtaacaacctgcctaatgtctctggtcatggtcttatgctggcacaaaaatgtccttctagcaatttgttttatattcttctttggttccattgaggctctctacttctcagcatctcttattaaattcctggagggggcctgggtacctattgccctctcatttatcttcctcgttgttatgtatgtttggcactatggaacactcaagaaatatgaagcggatgttcaaaataaggtctctatcaactggcttctcagtctaggtcccagtcttggaatagtccgggtccgagggattggtctcatacatactgagcttgtctctggaatcccagctatattttcccactttgtcacaaaccttcctgctttccaccaggtcgtagtcttcctctgcatcaaatctgtgccagtgccgcacgttagacctgaggaaaggttcttggtgggaagagttggtcctaaggagtaccgtctctacagatgcatagcacgatatggttatcgtgatgttcataaggatgatatggagttcgagaaagatcttgtttgtagcattgcagaatttatcaggtcagaaaaacctgaaagtgatataggaatagaagacgtaggggagtatgagaaaatgacagttattgggacactatcatcctcttttgaaggcgtaaaaatgcgcgaagacgatacagattcctctgatatggtaggaacttcagaggtgaaagagatacaggctcctcagaggtcaaaaaagagggtgaggtttgttgttcctgagagcccgcagatggatagggatgtccgagatgagttgcaggagctaatggaagcaagagaagccggaatggcattcatacttggacattcatacgtgagggctaagagaggatcaagctggatgaagaaagtggtgattaattatgggtatgatttcttaagaaaaaactccagaggaccgcgttatgctttgagtatacctcatgcatcaaccctagaagtagggatggtgtactatgtttaa

SEQ ID NO: 529 - DNA, 1251 bp, Ricinus communis
atggcgcacaccatggaaaggtttttatcagcagtagtatccatggacaatcaagtagcaggacagtcattaattgggactatcagaattgctgttttacctatagccaaagtttttaccatgtgctttttggggtttcttatggcctctaagtatgttaacatcttgcctgccaatggaagaaaattactaaatgggttggtgttttcccttttgcttccatgtttgatattctcccaacttgggcaagctgttactttaaggaaaatgatggagtggtggtttatacccgtgaatgttgttctgggctccatatcaggttcaataataggtttagttgttgcttatgttgttaggcccccatacccgtttttcaagcttactatcgttcaaattggaataggaaacattggaaatgtgccacttgtacttattgcagctttatgtagagatacatccaacccttttggtgactcagaaacatgcagcacagacgggactgcttatatctcatttggccaatgggttggtgcaatcatcctatacacatatgtatttcatatgttggcacctcctcctgaaggtacctttgacattgaggatggaaatcttcctatcaaggacactccaaaagatggtactccagagcaagttccactgcttacccatgaggatctaccaacagattctgatgcttcaaagcaagggaagttcaaagaaatactaatgtacttatatgagaagttgaagctcaagcaaatccttcaaccaccgattattgcttctattttggccatgttcctcggtgcagtaccattttttaagcgattgatctttacaactgatgctccactttacttttttaccgacagctgcaacatccttggggaggccatgattccatgtattttattggcattgggaggcaaccttgtggatggaccaggaacttcaaaacttggtttacggacaactgctgctattatttttgcccggttactcttggttcctcctgctggacttggcattgttatgttggctgataaacttggcttcctccctgccggtgataagatgtttcgttttgttctacttcttcagcattcaatgcctacatctgtccttgcaggtgcggtggccaatctgagaggttgtggaagagaggctgctgcagtactgttctgggttcatatttttgctgttttctcgatggctggatggattgttctttatctcaacatactgttttaa

SEQ ID NO: 530 - DNA, 1916 bp, Centaurea maculosa
gggcactgacacctgcgcggaactcggacagccaatacacacatatggtgaattgggctgcaccaccaagcgcgccgaataggcggcgcccccacggtgaatcctgccccacagagcgccgcgttataagaagaacagcttgggggtcacgtcccccgatagcttaaaggatacatacaaatgtgcaattggcaattctggggttcctcaatatggtggaactttcactggatgtgttcgttatccaaagagtaatcagaaggcttgtcaaacttttgattctactttgaaatcagaagttgctggcggacttcccctttttgttcttcttgtatcgtggagaatgttacttcacgttaaaggcatggaatgcacaaaaggccggagccgcagccattctcgttgcggacgacagacccgagcctctgatcaccatggacatgcccgaaaggaaacgcacacgtcgactacttgcaaaacatatccatcccatccgcactcatcagcatgtccctyggggactcrataaagaaagctctagccaagggcgatatggtaaatataaaactcgattggacagaagctctccctcaccccgatgagcgtgtagagtacgagttttggacgaatagcaatgacgagtgtggatccaagtgcgatagccaaatagagttcgtcaagaacttcaaaggggccgctcaaatactcgaacgaaaaggttacactcaattcwyrccgcattacatcacttggtattgccckgaggctttcactttgagcaaacartgcaaatcgcaatgtatyaaccatgggaggtattgtgctccggaccccgagcaagattttagtaaagggtatgacgggaaggacgttgttgtccaaaatttacgacaggcttgcttctataargtggcgaatgagaccggaaagccttggctttrgtgggattacgtgacggacttttctatccgatgtcccatgaaagacaacaagtacaccaaagagtgtgccgatgaagttatcaagtcacttggagttgatttgaagaaaatagatgaatgkgkgggtgayccagaagcaaasgkggataacccagtyctcaaggctgaacaagaagcmcrgataggcaaaggtacacgtggcgatgttacaatactgccgactcttgtgataaacaacagacaatatcggggtaagcytggcaaacaagcggttctgaaggccatttgctcaggattcgaggagaccaccgagcctgccctttgcttgagcgatgaartagaaacaaacgagtgtttagacaacaatggtggttgctggatggacaaagctgctaatattacagcatgcagggatactttccgtgggagagtatgtgaatgtccggttgtgcagggtgtaaagtttgttggtgatggttataaacattgtgaagcttccgcagcactgcgatgtgaagttaacaatggaggctgttggaaaggcaccaagctcggcaggacctactctgcttgtattgatgaccatacaaaaggttgcaagtgtccaccgggtttcaaaggagacggggttaacagctgtgaagatattgatgaatgcaaagagaagacggcgtgtcaatgctcccagtgcaagtgcaagaatacatggggtagttacgagtgtagctgtgctggcaatttgctctacatgagagaacatgacacatgtataagtaaagatggtaaatcagaagtcaactggggatttgtgtgggtcattattctcggtttggctgttgcgggtgctgcaggatatgcattctataaatacaggatccggacgtacatggattctgagatccgggctatcatggcacaatacatgccgttggacaaccaagcggaggttgaagttcacgggactcatggaaacgt

SEQ ID NO: 531 - DNA, 1069 bp, Centaurea maculosa
cttggcgggggttttctctgtattattattcatctttttcaattcaattctctctcaccacctcactcgtcgccctaattttcgcaattatcaaactcctccgatcaccctattattatattatatttgcaggaagaattggataaaaaggctctctggaattccacttttttggatcgagaccctgctgctttccatcgagagattgattgtagataagaaagaaacacaatgagttttcaagatattgaagctggtcgcccactcaattcgagacgtggtggtggtggattgaacaataatgggatgaggaaacaggatccgactcaggcggttgcttctggaatcttccagatcaatactgcagtttctacgtttcagaggctagtcaatacccttggcactcctaaagacacacctgagcttcgagataagctgcacaagactaggctacatattgggcaattggtgaaggatacgtcagagaaactcaagcaagcaagtgaaacagatcatcgcgcggatgtcagtgccagcaaaaagatcacagatgctaaacttgcaaaggactttcaagcagttctaaaagaatttcaaaaggcacagcggctttcagctgaaagagagacagcttacacgccttttgttcctcaagctgcttatccttcaagtgatcccgccaatgaaatggatgcaagctcaggtaaaagtcaagaacagcgtrctcttcttgtggacaataaaaggcaggaggttttgctgttggacaatgagattgcattyaatgaagctattatcgaggaragagatcarggaatacaagaaatccagaaccaaatcggygaggtaaacgaaatattcaragatcttgctgttttggttcacgagcaaggaactatgatcgacgatattggctccaacatcgagaattctcatgctgcgactgcacaggcaaaatcccacctcgcaaaagcatcaaagacccaaagatcaaactcttccatgacttgcttgcttttggtgatactggggattgtgcttcttattgtgattatagttcttgcagttt

SEQ ID NO: 532 - DNA, 875 bp, Centaurea maculosa
cggggactcacgacaagattgcaggaaacgaaaaaatggtggaagaagtgagaaataagcaggtgatattgaaggatttcgttaatggcttccctaaggaatccgatatgcttctcgatgcttcatccaccatatccctcaagcttccagaaccttccaatggcctcctcgttaagaacctttatctctcctgcgatccttacatgcgaggtcggatgagcgatattcaaggcagttacgttccatccttcactcctggctcgccaataacaggatatggagtagctaaagtattggattcggggcacccaaacttcaagaaaggtgacctgttttggggctttactggatgggaggaatacagcattatcaccgctcccgagagcctattcaagatcgaacatactgatgttcctctgtcctattatacaggaattcttggtatgcctggtatgactgcttatgctggtttctatgagatttgtgctccaaagaaaggagagtatgtgtttgtttcagcggcttctggggcagttggtcagcttgttgggcagtttgccaagttgtcgggatgctatgttgttgggagtgctggaacaaaagaaaaggttgagctgctgaagaataaatttggatttgatgaagcttttaactacaaggaagagcaagatctagatgcagctctaaaaaggtactttccggatggcatcgatatttactttgagaacgttggggggaagatgttggaggcagtgctgttgaatatgagattaaatggacgcatttcggtwtgygggatgatctcacagccaccacctggaacatagtgaggtggttcggaacctgtactgcctacttgcaaaacggttgcgcat

SEQ ID NO: 533 - DNA, 2020 bp, Centaurea maculosa
ggcggggcactgataagctctctaaytcgaggaataattcgtgtgattttgttgctaatttgctaatttgattgtgataatggatgaggatttcgatattccggcagctgaggagatgaacgatgaattcatggatgatattgaaggtccggttagtttgaaggttggtgaagagaaggaaatcggtaatcaaggtttgaagaagaagcttcttaaggaaggtgaaggttgggatacacctgaaagtggcgatgaggttgaagttcattatactggaacgttgctcgatgggactcagtttgattctagccgtgataggggaactccatttaagttcactcttggccaagggcaagtaattaagggatgggatcaaggtatcaagacaatgaagaagggtgaaaatgcacttttcaccatccctgccgatttggcttacggtgaaagcggttcgcctcccacaattcctccgaatgccactctccagtttgatgtgcaactgctctcatgggttagtgtcaaggatatttgcaaggatggtgggatcttcaagaagattgtgaaggaaggagagaagtgggagaaccctaaagaycttgatgaagttttagtcaattacgaggttaaacttgaggatgggactctaattacaaaagcggatggcgtggagttcacagtacaagatggtcatttctgtcctgcgattagtgcggctcttaagacaatgaagaarggagaaaaggttgttcttacagtcaaaccgcaatatggatttggggagaaggggaagcctgcttctggtgatcaagcttcagttccgccaaatgctacactccaaatcacactggaactcgtatcgtggaaggtcgtctcgaatgtcacagatgacaagaaagttgtcaagaaaatcttgaaagaaggcgagggatatgaacgtccgaatgaaggagctgttgttcaggtgaacttgattggtaagctacaagatggtaccgtattcatcaagaaaggccatgatggtgtcgaccctttcgatttcaaggcagatgaagagcaagtgattgatgggctggatagagctgtaatgacgatgaagaaaggtgaagtagctcttttaacaattgagccagaatacgctttcggttctgccggttccaagcaagaattagcggtggtgcctcctaatgcgactgtgacttacgaagttgagcttatctcgtttattaaggacaaagaatcttgggacatgaacaccccagaaaagatcgaggctgctggcaaaaagaaggaagaaggaaatgcattctttaaagctggtaaatatttgaaagctgtgaaacgatacgagaaggctgctaagtttatcgagtacgatactaattttgaggaagaggaaaagaaacaagcgaaagcattgaagattacttgcaaccttaataatgcagcttgccagttgaagctgaaagattacaagcaggctgaaaaactttgcaccaaggtactggaactcgagagcacaaacgtgaaggcactctaccggagagctcaagcttacatcaatgtggctgatctggatctcgcggagctcgatatcaaaaaagctcttgaaattgaccctaacaacaaggatgtgaaacttgaatacaaagtactcaaggaaaagattaaagaatacaacaagaaggatgctaaattctatggaaatatgtttgccaagatgaccaaatcatccaccaataaaccggctacgaaagatgcagaaccaatgaccatagacagcaaggcttaataaataagatgagatggatataattatggatttgggagtgttttaagagttttctggtatttttatggtctggtgctcttattggatgtggacatgttttagagaaaaggattggtgtaacaatgctcatctttgtttccttytttatccttttacttggagtcgaaaacgtgaactaattttattcgaaamacataacaagtratttgtttttttttctttctttctttg

SEQ ID NO: 534 - DNA, 1587 bp, Centaurea maculosa
cgcggggaccccaaattatgccttgtgccatttttacactttgctgctgaaagatgagcaaccatggagttggaaggtcttcatctctatctctcatctttggagcacttstatttgttctactctccatctgtgatttctcctactcagagatcatcttcgaggagcgatttgaagatgggtggcagagccggtgggtgaagtctgattggaaaagaagtgaagggaaggcgggtaattttaagcacacagccgggtcatggtctggtgatccagatgataaaggtattcagacaacgactgatgccagacattttgccatatctgcaaagattccagaattcaacaacaaaaatagaacattggtgttacagtactcgatcaaaatcgaacaggatatcgaatgtggtggtggttatatcaagcttatgtctggatatgtcaaccaaaagaaatttggtggtgacactccatatagtgtgatgtttggaccagatctatgtggcacacagacaaagaagcttcatgttatcctttcgtaccaggggcaaaattatccgatcaagaaggatctacagtgtgaaacagacaagttaacccatttctacacgttcatccttcggcctgatgcaagttatagcattctaatagatggcagggaaagagattccggaagtatgtatacagactgggatatccttccaccccgtaaaatcaaagacgtgaaggccaaaaagcctgctgattgggaggaaagagaatatattgaagatccagatcaagttaagcctgagggctatgattcaatcccgagagaaattcctgacccgaaagctaaacagcctgatacctgggatgaagatgaggatgggatatggagaccaccaaagataccaaatccggcatacaaagggccatggaagccaaagaaaataaaaaatccaaactacaaggggaaatggaagatcccttggatcgataacccagaatttgaagatgatcctgatctatatgtgctcaagccaattaaatatgtgggaatagaggtttggcaggtaaaagctggatctgtatacgacaacattctcatttgtgacgatcccgagtatgcaaaagatgtgatacaagaagttttcaccaatagagagattgaaaaagaagcattagaggaagcagagaaagcaaaaaaagcaagggaggaagaggaagcacaaagggcaagagaggaaggtgaaaggaggaagagagaacggggttatgatagaaggcaccgagataaggagcgctacaaggatagatacagaaagtacaatcgccgtgattaccttgacgattatcatgatgagctttgagatttgtcgatccatgccttaccgtgcagtgtgcagttaccacagccgatttatttcctttttcataattaaattgtagcattacttacggttgttgtaccatcgaactattgtcgggtaaaaatcccatgatgtgacctcttagggtgcagctaagttgcatttttgtggtgaacacttgcggatgcaaatttatcgtcaactttaagatcaatttgaaatttctggttgccac

SEQ ID NO: 535 - DNA, 1987 bp, Centaurea maculosa
gcggggattccatctcattttmatcwcagcartcgtggyagattgctattcaaacccttaagattctgaaaccagatttatatatcatttctttggcaacaagttaaaccctactggtactggagatcaacttcactaccttctttcaactccacagagtattataatgacgtcgaggaagatgctgatcgatggggatgttggtgagaatactgaagatatacagtatgattttgatttgtttgtaattggtgctggtagtggaggtgttagggcatcgagattttcagctcagtatggagctaaggttggcatttgcgagctcccatttcatccagtcagctctgaagtcataggaggtgttggaggaacatgtgtgattcgtgggtgcgttcctaaaaagattctggtctatggagcaacctttgggcctgaaatccaggattcaagggaatatggatggcaagtgaatgagaagattgattttgattggaaaaagttactgcacaagaagaccgaggaaattctgcggctaaatgggatatacaagcgcttactttcaaatgcaggagtgaaactgtttgaaggagaggggagaatcgtgggccctaatgaagtggaagtgatacaattggatggcactaaactgtcctatacagcaaagcacatactgatagcaactggtagcagggcggcacgtgtatctattcctgggcaggagctggctataacctcagatgaggcgttgagtttggaggagttaccaaagcgcgttgttgtacttgggggagggtatattgctgttgagttcgcttcaatatggcgtgggatgggctccacagtgaatctatgcttcagaaaggaacttccattaaggggttttgatgatgaaatgagagctctggttgcaagaaatctggaaggragaggcataattttgcacccacagactaacttgactgagctggtcaaaacggaggatggcataaaagttactacagatcatggtgaagaattaatggcagatgttgtacttttcgccactgggcgyctccctaatwcaaagagattaaatttgcaatcagtaggtgttgaagttgacagtgcaggagcagtgaaggttgatgagttctctcgcaccaatgtgcctagcatttgggccataggtgatgtcaccaatcgtatgaatcttactccagtcgccttgatggaagggactttgtttgctaaaacagtcttcggtaatgaacctagcaagcctgactacagcaatataccttgtgccgttttctgcatcccacctctctctgttgttggattaagtgaagaagaggccatagagaaagcccaaggagacattttggtgttcacatcaacatttaatcctatgaagaactccatctctggacgacaagagaagacactcatgaagcttatcgtcagtgcagagaccgataaagttctcggtgcctcgatgtgtgggccagatgcagcagaaattatgcagggaattgctattgcactcaaatgcggagcaaccaaagcgcaattcgatagcacggtggggatacacccttcatccgcggaggaatttgtgaccatgagatcagtcacaaggcgtattgccgcggctggtaaaccaaagaccaacctttaaaatacatgaacaagttaaaaacaccgttgttggttagttgtttctcacaactcgtatcgatagaaaaacacgtgggtggatatatgctatttttggctcaggattcgcgaccattgattgttgttagcatatgaataatgtggattgtttatttgttattttccgcgtgtggtttcttgaattgtctagaaaagctttcacaaaacatgggagaagatgaacaactttatttgcattaactgcgaattgttataattgttatgttctctttgaagtaggtgtaaggtcggttccaattgtgggatttcgttataactgttatgatctcgt

SEQ ID NO: 536 - DNA, 700 bp, Centaurea maculosa
attcggcgggggctctttggtaaggaaccctaggttcttsagattgtttcgttcttcagaagtctaccaaatccttcatccatcaggaacttcttttggatcctcgtgttcgtaagaatggcgacaactgaacaaccgaaggttgctgctaccgaagaagctaagattgatctgtttgaagacgacgatgagtttgaagagtttgaaatcgatcatgagtgggatgtgaaggaagaaggaaargaagtaagycaacaatgggaagatgattgggatgatgatgatgtgaatgatgacttctctcttcagytaaggagggaactggaaagcaacactgagaagaagtgaatgaaatctacatakgtaatcaractccatttcaaagtgattgtctttttggtataaaatctagactttgtgagtttcatcttcatatgcacctttcatttcataattgttttttttcacyattcaagaatttgaaatccttatagtttcatgattcatcttcyttgtcatattattggattggattggatcggatcggatcggatcggatcatgtattaaaagagtttcaatgagttgggttgtttttagttagttggattgggttgttcaaaggttcgggatccggccaatccatgtaaatcctgcatttgacagttactagtttgcgaaaataacatgatcctgcacag

SEQ ID NO: 537 - DNA, 1086 bp, Centaurea maculosa
cttggcgggatctcatttggagattttttcatttagggtttatttttgaaggataaagatgagctttcagatcttgaagcggtcgacctctcaattcaaagcgagttggatacgttaatggcggaggaaggcagcaagatcctacacaagctattgcttccggaatcttccagatcaataccgcagtctccacgtttcagcggctggtcaatacccttggtacacctaaagatacacccgaacttcgagaaaagctgcataaaacaagactacatattgggcaattggtgaaggatacytcagataaactcaagcaagccagtgaagctgatcaccggtcccaagttagtgccagcaagaaaattacagatgctaaacttgcaaaagattttcaagcggtcctaaaagaatttcagaaggcccagcgtctgtcagctgaaagggagacggcttacactccttttactcctcaagccgttcttccatcaagttatgcagccagtgaaatggatgtaagctcaaagagaggtcaggaacagcatgcccttcttatggaatctaggcaggaggttttgctgttggacaatgagattgcgttcaatgaggctattatcgaggaaagggaacaagggatacaagatattcagaaccaaattggtgaggttaacgagatattcaaagatcttgctgttttggttcatgagcaaggagctatgatcgatgacattggctccaacattgaaaattctcatgctgcaactgcacaggcaagagtccacctttcaaaagcatccaaaacccagagggcaaactcctccatgacttgcttgcttttggtgatagtcgggatcgtccttctcattgtgatcataatccttgcagtttgatcgatctcaaactgttgtgcgtatagataaaactgaagcttgtgtatggatttgatatgcttcctttgagcatcttgtgttctatctactaagattgatttcttctttggwtcakagtgygakaacattacttgaaaattatatttgtttgcagggattctttgtgtacaatcaacaagtcctctttgttttttcttac

SEQ ID NO: 538 - DNA, 1030 bp, Cichorium intybus
  misc_feature (959)..(959): n is a, c, g, or t
ggggattcagccaactatctatttcttcatttgcttgcttttggaagaataatttgtgtttaatcttgtacgagcgaatatggatgaggattttgatattccggcagctgatgagatgaacgaagaatttatggatgatattgaagctccggtgacgttgaaggtcggagaagagaaggaaatcggtaatcaaggtttgaagaagaagcttcttaaggaaggtgaaggctgggacgctcctgaaagtggggatgaggtcgaagttcattatactggaacattgctcgatgggactcaatttgattctagccgtgataggggaacgccatttaagttcactcttggtcaagggcaagtgatcaagggatgggatctgggtatcaagaccatgaagaagggtgaaaatgcccttttcaccatacctgctgatctggcttatggtgaagctggttctccccctacaatccctcccaattccactctccagtttgatgtgcaattgctatcatgggttagtgtgaaggatatttgcaaggatggtgggattttcaaaaagattgtaaaggaaggagagaagtgggagaaccccaaggacctcgatgaagttatagtcaattacgaagttcaactcgaggatgggactgtagttgcaaaagcagatggagtggagttcaaagttgaagatggccatttctgccctgctctacaaaaggctgtaaaaacgatgaagaaaggtgaaaaggtcatccttacagtcaaaccagaatatggatttggagaaaaggggaaaccagcatctggtgatggagctcccatccctgcaaatgctacactaaaaattaccctggagctcctatcayggaagattgtcacaaatattacagatgacaagaaagttatcaagaaaatcttgaaagaaggggaaggatatgagcgcccaaatgagggggctgttgttncagtgaatttgattggtaagctacaagatggtactgtattcatcaaaagaggtcatgatgacaccgaccct

SEQ ID NO: 539 - DNA, 1946 bp, Cichorium intybus
gcggggatccaattcatcaatcatcacgactgcttgtgtgtcgtggcaaattgatattcaaacccttagattctgaagcatattgattttaatttctctaagaacaagtaaaacccctaccggaaatccagtttagtacgattttcgtctgaagaaggtattctaatcatgtcgaggaagatgctgatcgatggagacgtgggcaatgatatcgacgaggctccttatgattttgatttgttcgtgattggtgctggtagcggtggggttagagcatccagattttcagctcagtatggagctaaggttggaatatgtgagctaccatttcatccggttagctcagaagttgtaggaggtgttggaggaacgtgtgtgattcgtgggtgtgttcctaaaaagatcttggtctatggagctacctttgggcctgaaattcaggattcaagggagtatgggtggaaagtgaatgaaaagatcgattttgattggaaaaagctactacacaagaagactaatgaaatagtgaggctaaatgggatatacaagcgcttactttcaaatgcaggagtcaaactttttgaaggtgaaggaagaattgtgggccccaatgaagtggaagtcatacaattagatggcactagattgtcctattcagcaaaacatatactcatagcaactggtagtagggcacaacgccccgatattcctggaaaggagttagctataacatctgatgaggctttgagcttggaggagttaccaaagcgtgttgttatacttggtggaggatatattgctgttgagtttgcttcaatttggcgtgggatggggtccactgtgaatctatgtttcagaaaggaacttccattaaggggttttgatgatgaaatgagagctcttgttgcaagaaatcttgaaggaagaggcataattttgcacccacaaacaaatattacaaagttggtgaaaacagaggatggaataaaagttactacagatcatggtgaagaattaatggcagatgttgtactttttgccactggtcgtgctccaaataccaaaaggttaaatttgcaaagtgtaggggttgaacttgacaggacaggagcagtgaaggttgatgagtactctcgcaccaatgttcctagcatttgggccataggcgatgtcacaaatcgaatcaatcttactcctgttgctttaatggaaggaactttattcgctaaaaccgtatttggtggtgaacctagcaagcccgactacaccaacgtcccttgtgccgttttctgcataccacctctctctgttgtgggactaagtgaagaacaggctatagatcaagctgaaggagacattttggtgttcacatccacatttaatcctatgaaaaactccatttctggacggcaagagaaatcactcatgaaacttattgtgagcgccgaaactgataaagttcttggcgcgtccatgtgtgggcccgatgcagctgaaattatgcagggaattgcggtggcacttaaatgtggagcaacgaaggcacagttcgatagtactattgggatccatccatcatctgcggaggagtttgttaccatgcggtcagtgacacggaggatcgcggcctctggtaaacccaggaacaacctttagaaaggtttgaccgtgtcggtttgacttggttatagttgttcctcacaactcaacatccatagaaaaagacatgggtatactttggttcatgaatttaattgttggcatttgaataaggtggattgggttttattggtttcttgggtattatgtaaaagattttgagtattggagacggtgagtttttgggagaattgaagtacttttgttgcgtgaagtataagttgtttatgcatgttagatttggagttcgaataggaaatggaatatatgttggttgatggtcaaaa

SEQ ID NO: 540 - DNA, 914 bp, Cichorium intybus
tttggtttgctttcaatcgccggcaatgcatacctgctctaccaccaccaccacatccttcccctgtgaatcatcgtgtccctttcgtttctctcacatcaatcggcgcccaaaatttatrttttckattartactrstccgagcaccgttgcagaacaaggaatttttttataagttgaggattatcgtagagatatacaagataagataatgagttttcaagatatcgaagctggtcgcccgctcaattcgagacgagggggctacaataatggcatgaggaaacaggatccgactcaagctgttgcttctgggattttccagatcaatacggcagtgtctacgtttcagaggctagtaaatacccttggtactccgaaagacacccctgagcttcgagaaaagctgcataaaaccagactacatattggccaattggtgaaggatacttctgataaactcaagcaagcaagtgaaacagatcaccagactgatgttagtgccagcaaaaagattactgatgctaaacttgcaaaagattttcaagcagttcttaaagaatttcagaaagcccaacggctttcagctgaaagagagacggcttacacaccttttgttcctcaatcttctcttccttcacgtgatccagacagtgaaatggatgtaagctcggataaaactcaagaacaacgcgttcttcttgtggactccaagaggcaggaggttttgcttttggacaatgagattgcatttaatgaagcgataattgaggaaagagatcagggaatacaagagatccagaatcaaatcggggaataaatgaaatattcaaagatcttgctgttttgggtcgcgagcaaggagctatgatcgatgataatggggtccacattgagaattctcatgctgccac

SEQ ID NO: 541 - DNA, 1165 bp, Cichorium intybus
gggggcggcattctcccccaatttgcgctaaataattcttcaatcttcattaaccctcacgccgattgctaaacctacccttaaagtcaccctttcgttcgggaccctgctcgatcggtaggggtttttcatctcaatcggaattatcctttgtcgttggattcacatcaattctcggagtttagggtttattcaagggataatacatcaggtatataagataagatgagctttcaagatcttgaagccggtcgccaattcaattcaaaacgaggaggatacacaaatggcgtcaggaaacaagatccgacccaagcaattgcttccggtatcttccagatcaacaccgccgtctctacgtttcagcggctagtcaacacccttggtacccctaaagacacccccgaacttcgagaaaaactgcacaaaacacgactacatattgggcaattagtgaaggacacttcagaaaaactcaaacaagcaagtgaaacagatcaccgtgctgaagttagtgcaagcaaaaagattacagatgcaaaacttgcaaaagattttcaagcagttctaaaagaatttcaaaaagcccaacgccttgcagccgaaagagaaacagcttacactccttttgtcccgcaagctgttcttccttcaagttatgcagccagtgaaattgatataagttcagataaaagcccagaacaacgtgcccttcttgttgaatctagaagacaagaagtattgttattggacaatgaaattgcgtttaatgaagcgattattgaggaaagagaacaggggattcaagaaatacagaaccaaatcggggaagtaaatgagatttttaaagatcttgctgttttggttcatgaacaaggagctatgattgatgatattgggtcaaatattgagaattcgcatgctgcgactgcacaagcaagaattcacctttcaaaagcatcaaaaactcaaagagcaaattcttcaatgacttgtttgcttttggtgatagtgggaattgttcttctgattgtgatcacgattctcgcgttttgacttttgaccataaagtcaaagatggtttatgggtcatgttgtaaaaggatttacattttctttgttacattgtgtgattactataatattacctacttgaaaatcaaaa

SEQ ID NO: 542 - DNA, 1917 bp, Citrus sinensis
ccattcataaacaaattttttcgatcgtttttatttcatcaattacgacagcatagtcattagtcattgctgcagcagcctctgcttttctttcaattccttaactcatctcttagttgaattgattaaagagcgatggcaaggaagatgcttaacgatggcgagctgagccagcccaatcaagaagaacaaactcattttgacttcgacttgtttgttattggagctggaagtggtggtgttcgtgctgctcgattttcggctaattttggagccaaggttgggatatgcgagcttccttttcatccgatcagctctgaagtaattgggggagttggtggaacctgtgtcattcgtggttgtgtacccaaaaagatattggtctatggagcatcatttggaggtgaacttgaggatgcaaggagttatggatgggaggtacacgagaaaattgacttcgactggaaaaaacttctgcaaaagaagacagatgagatactcagattaaatggaatttacaagcgattattatctaatgctggggtaaaattatatgaaggggagggaaagatagttggtccaaatgaagttgaggtcacacaactagatggcactaagttaagttactcagcaaagcacatattgatcgcaactggaagtagggctcaacgtgctcctattcctggccaggagctggctataacctctgacgaggcattgagcttggaagaattacccaagcgtgctgtggtgcttggtggagggtacattgctgttgagtttgcttccatatggcgagggatgggttctactgtggatctattatttagaaaggaacttccattaagagggtttgatgatgaaatgcgggcagtagttgccagaaatctggaagggaggggaattaatttgcacccgaggactaccataaaggagttgattaagtcagaggagggtgtaaaagttattacagatcatggtgaagagattgttgcagatgttgtactctttgccactggcagggcacctaatacaaaaaggttgaatttgaaagctgttggtgtggaagttgatcaaacaggagctgtgaaggtggacgagaactcacgcacaaacgtacctagtatatgggctgttggtgatgtaactaatcgaatgaatcttacccctgtcgccttgatggagggaatgtgctttgcaaaaactgtttttggtggacaaccctgcaaaccagactacagggatgtaccctgtgctgtattttgcatacctcctctctctgtagtgggtctcagtgaggagcaggccatagagcaaggaaagggtgatatccttgttttcacatcaagcttcaatcccatgaggaacactatctctggacggcaagagaagacagtaatgaagctagtggtggatgccgagacggaaaaagttcttggagcatcaatgtgtgggccagaagcacctgagataatgcagggtattgctgttgcactgaaatgtggagctacgaaggcacaatttgacagcacggtgggaatacatccttcctctgctgaggaattcgtgaccatgcggtctgtgacgagacgtgttgctgccgcaagcagcaatccaaagacaaatctgtaaggttcaatcaaatatcagagagaagcgggtttgatatttatactatgttggaacattatttgcttgaatataggtatttcgcgtttaccaaacacaggaaaaaggggggaaaaatgctggtatagcaggagtagcccagttttgtggtttttattttcacctaaataaaagtttcatcttcgaaaatattgtacaatggttttaattctgatggtgcaaacaacaatgtaattttattccttatcttcatatctttttatttgaataatatctataggtccccat

SEQ ID NO: 543 - DNA, 1209 bp, Citrus sinensis
gtaacccggatccgatttttcacaccgcactccgacctccttatatccgaaatttcaagtgaattctctctctctctctctctctatctctcgaayctcgatcgaacaaagaatcggatcggtcaaaatcaaggtaatctagagattgtaattggaacgacatgacgacggcagctcgacccacatgggctcccgcaaaaggtggtaatgagcaaggcggtactcgaattttcgggccgtcgcagaagtactcatcgagggaccttgcagctcatacaaatttgaagcctagaaaagaaggacaagataccaaagatgaattacagaaaaggaacctccggcatgagctagaagagcgtgaacggagacatttctcatctaaggataagtcctacaatgatgacagagatcgtcggaagagtagccatcttttgttggaagggacaaagagggatatggaggaccgtgctgctccacgtagcatagatgctgatgattctgatgtcgaagtcaaaagtgatgatgagagtgatgatgatgacgacgatgatgaggatgacactgaagcacttttggctgagcttgaactaataaagaaggaaagagcggaggagaagctccggaaggaaaaagaacagtgggaagaagaggctaaagccaaggaatcagagcttcttgtaggaaatccattgctgaataatccaacatcctttaatgtgaaaagaaggtgggatgacgatgtggttttcaagaaccaagcccgtggtgaaaccaagactcccaagcgcttcatcaatgacactatcaggaatgacttccacaggaaattcttacagaaatacatgaagtagcttcgctgaagtaaatctgaggtgaagggccaagttttactgcttcaatcaaagaaaaagaccttggtttaaatccttgtttgtattagtcattgactctgggtttgaatttgagggctaccatgtagtaagagccaaacatctgcagcaatatatgagaatatgaagctgaaattgttttcaatgagttgactgattactgaaacactgttaacacttatggtgattaagtgctagttaacatttgggctattgtaaagatttttatctttttccatgtctatttgataatgcctcccaaatcaccttgttgaattgatgtatatttaaaatatgttattttaaaagtgctgatcca

SEQ ID NO: 544 - DNA, 1921 bp, Citrus sinensis
agaagaagatggatgaggattttgatattccagctgcgaatgagatggacgcggacatggatcttcccgacgatgctcccatgatgaaggttggggaggagaaggagatcggtaatcaaggtttgaagaagaagcttgtcaaggaaggcgaaggctgggacactcctgaaaatggcgacgaagttgaagttcattatactggaacgttgctggatggtactcagtttgattccagtcgtgatagaggcactccttttaagttcacgcttggtcaagggaatgtgattaaaggatgggacataggtattaagactatgaagaaaggtgaaaatgctgtcttcaccattcctcctgagcttgcttatggtgaatctggytcaccaccgaccattcctccaaatgccactcttcagtttgatgttgaattactatcttggactagtgtcaaggacatttgcaaggacggtgggattattaagaagatcctcaaggaaggagaaaaatgggagaatcccaaggaccttgatgaagttctcgttaactacgaagctagacttgaggatggtatggttgttggaaaagcagatggtgtagaattcactgttaaagatggtcatttctgtcccacgttagcgaaggctgtaaagacgatgaagaagggagagaaggtacttcttgcagtgaagccacaatatggatttggggagaaagggaagtctgcctcaggcaacgaaggtgcagtcccaccaaatgcaacacttcagattgctttggagttagtttcatggaagactgtgtccgaaatcactgatgacaagaaggttatcaagaagattttgaaagaaggggatgggtttgagcgccctaatgaaggagcttttgtcaaagtcaaattgattgggaagctgcaagatggtaccgtgtttgtgaaaaagggtcatagtgaggaagagcagctgtttgagtttaagacagatgaagagcaagtcattgatgggcttgatagagcggtgattacaatgaagaaaaatgaggttgcactgctgacaatagcaccagagtatgcttttggctcggctgagtcgcagcaggagctggctgtagtacctcctaattcaactgtgcattatgaggttgagctggtgtcctttgaaaaggagaaggaatcgtgggacatgaatactgaggaaaagattgaagccgcggggaagaagaaggaacaagggaatacattgtttaaggcaggcaaatatgcaagagcctcaaagagatatgagaaagctgtcaagtacatcgagtatgatacttcctttggtgacgaagagaaaaaacaggcaaaggcattgaaagttgcttgcaatctcaataatgctgcttgcaaattgaaactcaaggattacaagcaggcagaaaaattatgcaccaaggtgcttgacttggatagtagaaatgtgaaagctctgtayagaagggctcaggcatacattcagatggcagatttagatttggcagagtttgatatcaagaaagcacttgagattgatcctgataacagggatgtcaagttggagtacaaaactttgaaggagaagatgaaggaatacaacaagaaagaggctaagttttatggcaacatgtttgcgaagatgagtatgtttggatctgctgaatccaataaagcagagcccaaggaggcagagcccatgagcgtagacagcaaggcatgactgaagtataatcaatttgatttttagatatatattaattgctggtttttgtgttccaattccatggattgtaggacttgttgggtcgtttgccttacagaatgagaagttgtaatggacctttcttttatttgagtacattttcttgatgaaccgatgacagtataagaaactccttacaaaaaaaaaaacac

SEQ ID NO: 545 - DNA, 1300 bp, Citrus sinensis
ccattcataaacaaattttttcgatcgtttttatttcatcaattacgacagcatagtcattagtcattgctgcagcagcctctgcttttctttcaattccttaactcatctcttagttgaattgattaaagagcgatggcaaggaagatgcttaacgatggcgagctgagccagcccaatcaagaagaacaaactcattttgacttcgacttgtttgttattggagctggaagtggtggtgttcgtgctgctcgattttcggctaattttggagccaaggttgggatatgcgagcttccttttcatccgatcagctctgaagtaattgggggagttggtggaacctgtgtcattcgtggttgtgtacccaaaaagatattggtctatggagcatcatttggaggtgaacttgaggatgcaaggagttatggatgggaggtacacgagaaaattgacttcgactggaaaaaacttctgcaaaagaagacagatgagatactcagattaaatggaatttacaagcgattattatctaatgctggggtaaaattatatgaaggggagggaaagatagttggtccaaatgaagttgaggtcacacaactagatggcactaagttaagttactcagcaaagcacatattgatcgcaactggaagtagggctcaacgtgctcctattcctggccaggagctggctataacctctgacgaggcattgagcttggaagaattacccaagcgtgctgtggtgcttggtggagggtacattgctgttgagtttgcttccatatggcgagggatgggttctactgtggatctattatttagaaaggaacttccattaagagggtttgatgatgaaatgcgggcagtagttgccagaaatctggaagggaggggaattaatttgcacccgaggactaccataaaggagttgattaagtcagaggagggtgtaaaagttattacagatcatggtgaagagattgttgcagatgttgtactctttgccactggcagggcacctaatacaaaaaggttgaatttgaaagctgttggtgtggaagttgatcaaaaaaggaactgggaaagggggacaaaaaactccccccaaacgttccttaaaaattaggggggttttgggggaggtaaataatataaaaggaaatctacccccctgtgcccccttgggggggggggaaaagggtttttgtcaaaaaaaatgttttttggtgggggggaacccccccccgccaaacaaccaaaaaaacaacggggggaggagggacccccggggg

SEQ ID NO: 546 - DNA, 903 bp, Citrus sinensis
tatggctttggatatagcacgtggcgtgagttatcttcatcattgcaacccaccaatcattcatcgcgatttgaagtcttcaaatcttctagttgataaacactggactgtcaaggttggtgattttggtctgtcacgtytgaagcatgagacatatctcaccaccaagactgggaagggaactcctcaatggatggcaccggaagttctccgaaatgaaccctccgatgagaagtctgatgtatacagctttggagttatattatgggagctcgccactgagaagatcccttgggataatctcaactcaatgcaggtgattggagctgtagggttcatgaaccaacgcttagagatcccaaaagatgtggatccacggtgggctgctatagttgagagctgctggcacagtgcaggccatcattccaggaactggtggacaagcttcgagatctgcagagacaatacttccaggcatctcgatcaacagtaggagatagcacccagaaggaattgtagaccatattcacattgtttccctgttccgttgctgaaacaacgtcattgcaagtagaagaatcaggcattatttttcacaaaagatttactttcttggctggtaaacagctggttacaacagatttgccactcaaaaggcttgtgctattggcgccgcatagctaccagacaatgaaagaaagaaagaaaaaaagttaaaaaggccaaagggtgggtagttggcataatgtgagctgtctaattttgatggtgattgctttgctagtttgcttggctgtgaaatgtttatttatttatataacctgatgtagcaaaaatcttcagtatctgtcagtagtgctttgtgatctggagtcgtgtttggtggaattacgtcacccattc

SEQ ID NO: 547 - DNA, 1096 bp, Citrus sinensis
aaagaaagcgcgagctctttctaattgtatcaagctaaaccgcagcgatgggagacacgtcagcatcaacagcagccgatgatgatttgcttctcaagagcttctttgccgaagtcagtgaagttgaaagagataacgaagtgcttaggattctttcgtgcttcaagcttaatccatttgagtatctaaacctaccatttgatgtaactccagatgatataaaaaagcagtatcgcaagctatccttgctggttcaccctgataagtgcaagcatccacaagcaaaggaagcttttggagcattggcaaaagcccagcaactattatcagatgaacaagaaagggactatattctaacccaggtccatgcagcaaaaggtgaacttagagccaaaagaaagaagcagttgaagaaagatgcagcttcgaaaataaaatcattagttgatgaggggaagtatgaacaacaatatgaacagtcagaggagtttcagcaggaactgaaattgaaggttagagaaatattaacacaacaagaatggcgaaggaggaaaatgcagatgaggatatcagaagaggaaggtagattgaagaaggatgaagaagaacaaaaagaaatgtggaaaagaaagcgtgagcatgaggagcaatgggaaggaacaagagaacagcgggtttcaagttggagagatttcatgaagacgggaaagaagggtaagaaaggagaaattcgacctccaaagcttaaaactgaggatcccaacaaatcttatgttcagaggcctgtaaagcgaggttaaccgatttagtgctgaggactgtgattggcaactacccatggcatcttcggaggtggagatgactctggatttaccccagaattgtatgattttgtgcccttgtgtgtatgaaggcaaattattgtggcggaaaagagcctctttaacagttgccatttgcctcgtaaagcaagccggaacagctatttagtattgacttaatccctgtttgggatttctgatcttaattagggaggatgattgaagaagagtgtataatgcatattattgagttacatgaggttttatagttcatt

SEQ ID NO: 548 - DNA, 1414 bp, Citrus sinensis
gggggcggagttctcttgtattcccgttgggctctcagctatccttttgtccaatcacaccaaatatcaatcggctttggagaaaatgagctttcaagatctggaggcggggcggccggtgagttcgttgaggagaaatttggtgaatggaaagcaagactcaacgcaggccgttgcttctggaatcttccagatcaataccgccgtctccacgtttcaaagactcgttaatacgcttgggactcccaaggatacgcccgagcttcgcgagaagatacacaagacaaggctacatatcgggcaattggtgaaggatacttcagctaaacttaaacaagctagtgaaacagatcatcatgctcaagttagtgccgacaagaagattgcagatgctaaactagccaaagattttcaagcagttttaaaagagtttcagaaggctcaaaggcttgctgctgaaagggaaacagcatacactccttttgttccacaggcagttcttccttccagctatacagcccatgaactagatataagttcagataggagtgcagaacagcatgcgcttcttgtggaatctagaagacaggaggttgtgctattggacaatgagattgccttcaatgaggctataattgaagagagagagctcggaatacaagaaatccaacaacaaattggtgaagtgaatgaggttttcaaagatcttgctgtattagtccatgagcaaggaactatcattgatgatattggatctcatattgaaaattcccaagtagcaactgcacagggaaaatcacaactcgtgaaagctgccaagacccaaagatcaaattcttctttgacctgtctgcttttggtgatatttgggatcgtgcttcttatattggtcgtagtacttgcagcttgatcgcaatattatctcaatgggagtatagagataaatctgagaccacctgcaacgagagggtgatctcttgctgatctctttgctgatgtttcatgaagaatcattgctgaggagcatgtgtcggacgtttagtgttactgcataatagggttgcatccagttaggacatctgagttgcttgggtggcgggtgtctttttgttactctaagttggtgcttctttgggtttgtggaatttgtgtttcggcttattatgtaatgtctcttttctttttaatcattaattaaaaaatggttcgtaattccttgggttttcttgtagttcattagcaactaagctgtttatgcttttttatgttctcatttaaaaggtcgtccggatattgtttcttggatgaaggtcgcatcgataacttgatgcctcaatttttagagtataggttggttcaatttggcttgagagaggtgccctagacgtgcaatgaattttttcagttcttctaa

SEQ ID NO: 549 - DNA, 566 bp, Trifolium repens
  misc_feature (532)..(532): n is a, c, g, or t
  misc_feature (549)..(549): n is a, c, g, or t
ttcaggacatacaatccggccgccgaaacctaaccaacggcaaacaagacccgacgcaagcggtggcttccggcgtattccagatcaacaccgccgtttccacttttcagagactcgttaacactctcggaacccccaaagacacgccagagcttcgcgagaaactgcataagacgagacttcatattggacaattggtgaaggatacttctgataaacttaagcaagctagtgaaattgatcatcatgctgatgttaatgcaaccaagaagatagcagatgctaaattggcgaaagattttcaggcagtgttgaaagaatttcagaaggcacagcgtcttgcagctgagagggagacagcttacactccttttgttccacaagcagttcagccatccagctatacagtcagcgaagcaggtgttagttccgataaaagccaagaacagcaggcccttcttgtggaatccagaagacaggaggtaatatccttagataatgagatttccttcaatgaggctatcattgaggnaagagaacaaggcattncagaaatccagcagcag

SEQ ID NO: 550 - DNA, 980 bp, Trifolium repens
tttggattatgaaattttgtgggaggatttgacgattcgagaacaaattggacagggttgttgtggaactgtgtaccatgcgctgtggtatggatcagatgttgctgtcaaggttttctcaaagcaagagtattcggatgatttgatacagtccttcaggcaagaggtatctgtcatgaaaagacttcgacacccaaatattcttctctttatgggagcagtgacttctcctcaacgtctctgcattgtgacggagtttctcccacgaggaagcttgtgtcgcttgttacatagaaacacgtccaaacttgactggagacggcgagttcatatggctttggatattgcacgaggcgtaaattatcttcatcattataacccgcctattattcatagagatttgaagtcttcaaatcttctagttgataagaactggactgttaaggttggtgattttggtctttcacgtcttaagcacgaaacatatctcacaactaagacaggaaggggcacgcctcaatggatggcaccagaagttcttcgtaacgaaccgtcagatgaaaagtctgatgtatacagcttcggggtgatattatgggaacttgcgactgaaaagattccttgggataatctcaacgcaatgcagataaataatggatggcaatattccactctgatcccaattaaggaatcctgtgtttacgaggtttgaactggaaaacagacaatgtagaagggcttgaagggtaaacaaatcaagttttgtaatgttaagtttatagttagtgatatgtatttgagttgaataagcactagttaatgatatgaagtcattgctatattttagctaatgctcagtgttatagttgaataatatataccaaattaagctgtagtacagtaacaattttcaaattgaatattgtaatcttttttacttgagtaaaacatggtacattatcttttggaggctaaaaaaa

SEQ ID NO: 551 - DNA, 1368 bp, Coffea arabica
aaacttccctttaattttccccaagtcccccttctccaacttgtttacttttattccctctataattaacaatctcgtgttcaaagattttcaaaaaattttctctaccctcagttctccataagtctcgccttggttttctttgcggctaaaattcttcaccccaattttcacctctcaagtttgattcttgtccggctggaatcatcaatccctcttttcccctcaattttccccaaattgaaacccaattttcccaataacaggaaaatagtataacttttttgatatttttttgtacaggatttttttgtttggggaattttgttgggttttgagagatgagttttcaggatctagaatcggggagggcaattgggtcgcggccaagagggttggtgaatgggaaacaagacccgacccaagctgtggcgtcggggatttttcagatcaataccgccgtctccacttttcaacggctagttaataccctcggaactcctaaagacacacctgagctccgtgagaagctgcacaagacgaggctgcacatagggcaattggttaaggatacctcagcaaagctgaagcaagcaagtgaaacggatcaccgtgttgacgtcagtgccagcaagaaaattacagatgctaagcttgctaaagatttccaggcagtcttaaaagagtttcagaaagcccaacggcttgcagctgagagggaaacggcatatacaccttttgttcctcaagcagtccagcaatctagctacactgctggtgagacagatgtgaattcagataagagttcagaacagcaagcacttcttgtagaatctagaagacaagagatcttattgttggataatgagattgccttcaatgaggcgataatagaggaaagagagcagggtatacaagaaatacaacaacagattggtgaagtaaatgacatatttaaagatttggctgtgcttgttcatgaacagggaaatatgattgatgatattggttcccatgttgagaatgctcatgccgcaacagcgcaagggagatcacagcttgccaaggctgcaaagacacaaagatcaaactcatctgtgacctgcttgcttctggtcatttttgggattgtgcttctcattgttattgtattacttgctgcctagtgagaaaagtttgaatatgattggatggagaatttacgtctactcgacaatcctgtgatcaagtttgttttgtgaagcactgcagctgattggatcgcgccactcactgaaattgtatcaatagcaagatttatgacctccattgccatattaagtttttattttttgggtggggattggtgttgtattttgtgattggcag

SEQ ID NO: 552 - DNA, 968 bp, Coffea arabica
acttgccaaatgatctgggaagagaaccaaccgatggtgaattagccgaggcaacaaacttggacgttcttcatctgaggaaagacatcaaagttggtcaagcggcaagaaacaarttgattaagcataacctccgcctcgtcttgtttgtaatgaacaaatatttccaagactttacgaatgggcctaaattccaagacctctgtcaggcaggagtaaagggacttatcacggccatcgaccgctttgaaccgaaacgaaagttccgcctttcaacgtatggcctcttttggatcagacatgccatcattcgttcaatgacactttcaagcttaaccaaggtttcctttggtcttgattcggtcagaatagaaatacagagggccaagttggaattgttgtttgagcttcagagaatgccaacagaggacgaaataatagagagggttggaatttcccctgaaagataccatgaagtgatgagggtgtcaaaccctatattgtcgctccatgcaaggcattcagcaactcaagaagagttcatcaatgggattacggatgttgacggtgttgaaggagaawakcggaggcaacctgctcttctcaggcttgctcttgatgatgtgcttgattctttgaagcctaaggagagtttagtaatcagacagagatatggacttgatggtaaaggtgatcgaacactgggggagattgcaggaaacttgaatatctccagarraatggttcggaagcatgaagtaaaggctctcatgaagctcaagcatccagctcgagtggattatcttcgccgttacgtttactagaagaacacttccatccacacagagactgctgcatgatccacgtctttgcagccttccgttgtaatagccgtatactactaattgttgtacactagacacttgtatcatagtcacaaaaatttcaggctcacgggtcctttattt

SEQ ID NO: 553 - DNA, 985 bp, Coffea arabica
ccagagttcgacttctccaaccgtccaacgccacctcccgccccttttttggccctgcrctctagtcaaagttattttttaactattttcttcctgaaagcaaaagggaaaaaaaaaatgggtgttcgagaaactgacccgctttcacaactgagcttgccacctgggtttagattctatcctacagacgaggagctgttggtgcagtacctctgcagaaaagttgcaggccatgattttaatcttcaaattataggagagattgatctttacaagtttgacccatgggatcttccgagtaaggcgatatttggggagaaagaatggtacttttttagccccagggacaggaagtacccgaatggatcgagacccaatagagttgctggctccggctactggaaagccactggaaccgacaaggtcatcaccaccgaaggacgtaaagttgggatcaagaaagccctcgttttttatgtgggcaaagcacctaaaggcaccaagaccaattggatcatgcatgaatacagactctccgagccttcaaggaaaaatggtagcgccaggttggatgattgggtgctatgtcgaatttacaagaaaaattcaagtgcaggtgcaaagccggtttctgggcttcagagcagagagcacagtcatggctcatctacgtcatcctcatctcagttcgacgatgttctcgagtcgttaccggagattagtgaccggtttttcgccttaccaagaatgaactctctcaagaatctccaccaagatgatcagaaaatcaatattcaaaacttgggttcagggagctttgattgggcgaccctcgccggactgaactcggtggcggaactcggtcccggaagccaagctcaagctatttccgcagcagctgcacatggacatgtgaacaacaacgtggcccgctgcaataacaaccgataggaataatggtgaatgcccaggaatgacatggtac

SEQ ID NO: 554 - DNA, 1341 bp, Gossypium hirsutum
gcctctagaacctacattcacccataaaatccctttccttgcgttcctccatttcttagcttttgaaagcttccctgttcacgctcattgttcacttgtcacgcacacattagctccctatctcttagcctcttctattcgaaatggatgaggattttgatatcccgctggtggaggatgtgaatgacgacattgatcttcccggggatgttcccaccttgaaggtaggagaagagaaggagatcggaaagcaaggcttgaagaagaagcttgttaaggaaggtgaaggttgggaaaatcctgaaaccggcgacgaagttgaagttcattatacggggacgttgctggatggaactaaattcgattcaagccgtgatagagggactcctttcaagtttgctctcggtcaaggacaagttattaaaggatgggatgaaggtattaagacaatgaagaaaggtgaaaatgctatttttaccattcctcctgagctggcatatggtgaatctggctcaccgccaaccattcctcctaatgcgaccctccaattcgatgttgaattgctctcttggacaagtgtcaaggacatttgtaaagacggtgggctatttaagaagatactgactggaggagagaagtgggagaatcccaaggaccctgatgaagtgttagttaactatgaagctaagcttgaggatggaacagtggttgcaaaagctgatggcaaggagttcactgttatggagggtcatttctgtcctgctttggctaaggctgttaagacaatgaagaaaggggagaaagtacttcttacagtgaagccgcaatatggctttggtgagaaggggaagccagcaggtggtgctgaaggtgcagtgcctccaaatgccacactccaaatcaccttggagttggtttcatggaaaactgtttctgaggtcacagatgacaagaaggttatgaagaagatattgaaggaaggagagggatatgagcgaccgaatgagggggctgttgtcaragtgaaattggttgggaaactgcaggatggtaccgtcttcttgaagaaaggtcaagatgaaggacaagaattgtttgarttcaggacagatgaagagcaagtcattgatggtcttgataaagctgtgatgactatgaagaagggtgaagttgcactgttgactattgctcctgagtatgcttttggatcatccgggtcaaagcaggagttgggcttcggtaccccctaactcgactgtgtattatgaggttgagatggtgtcatttatcaaggataaagaatcatgggatatgaacaccccggaaaagattgaagccgca

SEQ ID NO: 555 - DNA, 909 bp, Gossypium hirsutum
  misc_feature (787)..(787): n is a, c, g, or t
cacaaacttcggatacgaaatccgaatctccatttcggagcttgaggatgttttgtcggacggtaactctcccttgttggagcgttggggaaaagcgacatgtatcgaatcgaaactccttttccacttggcagcgccggctgtcattgtttatatgatcaactatctcatgtctatgtccacccaaatcttctccggtcatctcggtaatcttgaactcgccgccgcctccctcggaaacactggcatccaagtctttgcttatggcctcatgttaggaatggggagtgcagtggaaacgctttgcgggcaagcctttggagcacacaaatacgacatgctaggcatatatcttcaaagatcagcagttctcctcaccttcacagggattcttctcacactcatctatgtcttctctaaaccaatcttattattactaggtgaatcgcctgatattgcttccgccgctgcaattttcgtctatggtctaataccacaaatcttcgcatacgccttaaatttccccattcagaaatttctgcaggctcagagcatagtggcccctagcgcttacatatccacagccacattattcatacatctgttgatgagttgggtggcggtgtacaaaatggggcttggtttgttgggtgcgtccttggtgttgagcttgtcgtggtggattgtggtggttgctcaatttgtgtatatagtgaaaagcgacaagtgcaaatatacatggaatgggttcagcagtcaagccttcactggcctgccgggattcttncagttatcggcgtcgtcggcggtgatgttgtgcttggaaacttggtattttcagattctggttttgcttgcagggttgctcgagacccagaattggctttggatcactctccatctgcatga

SEQ ID NO: 556 - DNA, 1286 bp, Gossypium hirsutum
gccttctcgccgtgtttgttattttcccaccctctttcccgaaaaaatttaatctcaaaattttctcgggaaagcgagggtttattacaaacacagctatatagtggagcagtaatcatgagctttcgagatctggaagccggacggccattggtgtcgaggcaaaacctaatcaacggcaagcaagacgccacgcaagcagttgcctctggcattttccagatcaacaccgcagtctccacctttcagcggctcgtcaacgccctcggtactcctaaggatacgcctgagctccgagaaaagctgcataaaacaaggctacatattgggcaattagtgaaggacacttcggctaaacttaaacaagctagtgaaacagatcacagtgccggaattagtgccagcaagaaggtagcagatgctaaacttgcaaaagattttcaagcagttttgaaagagtttcagaaggctcaacgacttgcagctgaaagggaaacatcatacgctccatctgttcccaaggcagttcttccttcaagttactcggctgatgaggtagatgtaggttcagatggaggggctgtacagcaagcctttcttctggaatcaagaagacagaaggttttgctgttggataatgagatcacatttaatgaggctgtcattgaagaaagagaacaaggaattcaagaaattcagcagcaaattggtgaggtgaatgagatcttcaaagatctcgcagtgctagtacatgagcaaggaactatgattgatgacattgggactcatatcgagaattcacgggctgccactatacaggctaaatcccaacttgcgaaagctgcaaagactcagagatcaaattcttccctgacctgcttgcttatggtgatatttggaatcgtgattctgattgtggtcatactactagtagtctaatcggaaactaaagatcatctcagcaacgagacggtgatctcttcgcctatgtatttgattatgttgttctatgagaaatgatggccaacaggagttcactcctagtcttagtatactatattgcgggtagctctatcatccattatcatcatgtgtttgttctttgggatggcggtgtgtctcttttctgaaagttggtgtttgggtttgtagactttttgtgtattttacccttttgttttacacttcttctgatatttaccgtggtaagagttttaattctttggttttcatgtcaatatgcatacatacatatatgcatttgcatagtgtcttatttccatgaa

SEQ ID NO: 557 - DNA, 1446 bp, Gossypium hirsutum
aaaacgtcaaattcttttctccttcctatctgtcgcgatccctcaactctctcctgttcttagacccttttactccaactgcaactgaacagcctgctsggctcgcatgttattttcattttcccaaaatctttttctaaagaaastttatttttctggagaaagttaggggttatatcaatatacttgtagagaagtagcgatcatgagctttcaagatctggaagctggacggccattagggtctcggcaaaatcttaacaacggcaagcaagatgccacccaagcagtggcttctggcattttccagatcaacaccgccgtttccaccttccagcgactcgtcaataccctcggcactcctaaggacacgcctgagctccgagaaaagctgcataaaacgaggctacatattgggcaattagtgaaggacacttcggccaaacttaaacaagctagtgaatcagatcaccgtgctgaagttagtgcaagcaagaaggtaactgatgctaaacttgcgaaagactttcaagcagttttgaaagagtttcagaaggctcaacggcttgcagctgaaagagaaacagcatacactccttttgttccccaagctgttccttcttcaagctacacagctggtgaggttgacacaagatcagacgaaagtgctgaacaaaggggccttcttgtgcaatccagaagacaggaggtattgctgttggataatgagattgcatttaatgaggctatcattgaagaaagagaccaaggaatccaagaaattcagcagcaaattggtgaggtgaatgagatcttcaaagatttagccgtgctagttcatgaacaaggaactatgattgatgacattggaacccatattgaaaattctcgggctgcaactgtacaggcaaaatctcatcttgtgaaagctgcaaagactcagagatcaaattcttccctgacctgtttgctactggtgatatttgcaattgtgattctgatcgtgatcatagtactggcagcctgatmmacaagctcatccaatgtgtttggagaaccattttagtaggggtcggaaaagcccctaattcggggtaatttgtttgtaatttcccatggatgaaatggtttgggtaaccatttggatttaaaaagtttccccaaattggggggaccttaaaaaatccttaaaaacttctcgggaaaaaggaggggaaactttttgggaaaggcatttgaaacttggttggttttgggagggatgaatgtctgaagtgggattttcccctaaaaatttttaaaaaaaatatgcagagggggggtttcctgggcctatttcattatagaagggttttttctgttttatttttccggggggggggttctttttttttaggtgggaaagagtgggttttttttgggggggggttgtgtgggggggggggg

SEQ ID NO: 558 - DNA, 1772 bp, Gossypium hirsutum
  misc_feature (1062)..(1062): n is a, c, g, or t
  misc_feature (1143)..(1143): n is a, c, g, or t
  misc_feature (1153)..(1153): n is a, c, g, or t
  misc_feature (1469)..(1469): n is a, c, g, or t
ggcacgagcggcacgaggttagaagcctctagaacccaccgtctttttctttcttggtcttaccttagtctcttcccttcgcatctcaaagcttcccattcacactcggttcttcgtttttgacgagctaactcactcagtcagttactcgttctctctttggctcactcgctcgatctctctctagatttttccgattacaaatggaggatttcgatatcccggcggcggaagacatgatgaacgaagatatggatcttcccgacgacagtcccattctgaaagtcggagaagagaaggagatcggaaatcaaggcttgaagaagaagcttgttaaggaaggtgaaggttgggagtatcctgaaatcggagacgaagttgaagttcattatacggggacgttgctggatggaacacagttcgattcaagccgtgatagaggcactccttttaagttcactctcggtcaaggacaagttattaaaggatgggatgaaggtattaagacaatgaagaaaggtgaaaatgccatctttaccattccccctgcacttgcgtatggcgagtctggttcaccaccgaccattccccccaatgcaaccctccaatttgatgttgaattgttatcttggacaagtgtcaaggatatttgcaaagatggtgggttatttaaaaagatacttattgaaggtgacaaatgggagaatccaaaggaccttgatgaagtgctcgttaactatgaagctaagctcgaggatggcacagcggtggcaaaagccgaaggcgtagagttcactgttaaggatggtctattctgtcctgctttggcaagggctgttaagacaatgaagaagggggagaaggtacttcttacagtgaagccacagtatggtttcggtgagaaggggaagccagccactggtgctgaaggtgcagtgcctccaaatgccacactcttgattactttagagttggtttcatggaaaactgtgactgaagtaactgatgacaagaaggttataaagaagatcttgaaagaaggagagggatatgagcgcccanatgagggggctgttgtccaagtgaaattgattgggaaactgcaagatggtaccatatccttgaagaaaggccataatgaangagaagaatngtttgagttcaagttaaatgaagaacaagtcattgaaggtcttgatagaactgtgtggaatatgaaaaaaagtgaagtagcactgttgactattgcactgaatatgcattggggttatccaattcaaaacaggaattggtttgtgtaccggtaaccccactgtttactataaagttaattgggttcatttgtccaagaaaaaaatcatggaatcgaaacccccaaaaaaaatttaacctgttgttaaaaaaaagaaaaagaattttttttcaaggtggcaaattttaaaactttaaaaaatttaaaaggcggtaanttttggtttaaacccccttaaggaaaagaaaaaaacacccagggtttaagtactttactcaaaaaagggttgaaattaaataaggcccaaaccggctaaaatggtccccagtttaaataaaaagcaacgaaaacccttttagggcccccacttatttccccatgtttggggggcgtatataaaccttccgctcccccaaaggggggggccccaaactctgaaaacaaggttacacaggacccctttgcctgtgcgaaaaaaagtggggcccaacccggcaacaccacatataaggggggcgta

SEQ ID NO: 559 - DNA, 2070 bp, Gossypium hirsutum
ggcacgagcccgtttcccctcttccagaaattcctagtgcctgactgccctcctccatttttttctcaaccttcaactccggcaccgatccacttccagtccggcaccgatccaccttcggtcctccacggctccacccatttcccccatttcctgtttcccttcttccacaaatccctaaccccttgcccgactgccctcctcccttttttctcaacctccacctccggtcctccacggctccactcatttccagaattagagtgtttccatttcgaagtgaatcatggcgaggaagatgttagttgatgaggaaatgaaccaaacgaatcaagaggaggctcattatgatttcgacttgtttgttatcggtgccgggagcggtggcgttcgtgctgccagattctccgctaactacggagctaaggttgggatttgtgagctcccatttcatccaatcagttcagaagtcattggaggagttggtgggacgtgtgttattcgtggttgtgttcccaaaaagattttggtctatggagcggcatttggaagtgaacttgaggatgctcggaattatggwtgggagttgaatgagaaacttgattttaattggaagaagcttctacataaaaagactgatgaaataatcagattaaatggaatttacaagcggttattatcaaatgctggtgttaaattgtttgaaggggagggaaagattgtaggtccaaatgaagttgaggtgacacaactggatggcaccaaattgtcctattcagcaaagcatatactaattgcaactggcagcagggcacaccgtcctcctattcctgggcaggagttgggcataacttctgatgaagcattgagtttggaggacttgcctaagcatgctgttgtatttggaggagggtacattgctgttgagtttgcatcaatatggagagggttgggcgctaatgtcgacctctttttcagaaaggagcttcctttgagagggtttgatgatgaaatgagggcagtggttgctagaaatctggaaggaaggggaattaatttgcatccacagacgaatttgactgagttgattaaaacagataatggcataaaagttactacagaccacggtgaagagttgatagcagatgttgtactctttgccacaggcaggttaccaaactcgaagaggttgaatctggaagctgtaggtgtggaacttgataacacaggagctgtgaaggtggatgagtactcacgtactagcattcctagtatatgggctgttggtgacgttacaaatcggatgaacctaactcctgtagccttaatggaaggaacctgctttgcgaaaactgtttttggtaaggaacctagcaaaccagactacagccatgtaccttgtgctgtttttagcatccctccactttctgttgttggtctcagtgaagagcaggcaattgagcaagcaaatggtgatgttctggttttcacatcaaccttcaatccgatgaagaacactgtatctggacggcaagaaaagactgttatgaagttagtcgttgatgcggagactgataaagtactcggtgcatctatgtgtggtccagatgcacctgaaattatgcagggcattgctgttgcactgaagtgtggagcgactaaagcacaatttgacagcacagtcggcatacatccttccgctgccgaggagtttgtgaccatgcgatctgtttcacggcgtattacctgtagcgggaaaccaaagacaaatctgtagacaacatatcaaggaaacttgcagtcctggtgatatagaagcaacatttcttatgatcatagatatttcagagaaaaggtaatagttaattggtaagggttatatttggtttgatctttattcacaataaaaggctcatctatcttattttatgttgtatttgttaaaaatagtggccaccaccaatgtatttttacctttgtaccttatcagcgtactgaaaaatttggattagcatcattgagttctgtagtaatgaaaagttattattggactatgttaacggtttagtt

SEQ ID NO: 560 - DNA, 1239 bp, Gossypium hirsutum
  misc_feature (1228)..(1228): n is a, c, g, or t
aaactgtttctgaggtcacagatgacaagaaggttatgaagaagatcttgaaggaaggggagggatatgagcgacctaatgagggggctgttgtcagagtgaaattggttgggaaactgcaggatggtaccgtcttcttgaagaaaggtcaagatgaaggacaagaattgtttgagttcaggacagatgaagagcaagtcattgatggtcttgataaagctgtgatgactatgaagaagggtgaagttgcactgttgactattgctcctgagtatgcttttggatcatccgggtcaaagcaggagttggcttcggtaccccctaactcgaccgtgtattatgaggttgagatggtgtcatttatcaaggataaagaatcatgggatatgaacaccccagaaaagattgaagccgcaggtaaaaagaaggaagaaggaaatgtattgttcaagtctggaaaatatgcgagagcttctaagagatatgaaaaggcagtaaagtatatcgattatgattcttccttcagcgaagaggagaaaaagcaagccaaggcattgaaggttgcttgcaatctgaacaatgctgcttgcaagctgaaactgaaggatttcaagcaagctgagaaactgtgcaccaaggttttagaaatagaaagttcgaatgtgaaagcgttgtatagaagggctcaagcatacatccatctggcagatttagatttggctgagtttgatgtcaagaaagcccttgagattgatcctgataatagggagataaagatggaatacaaattattgaaggagaagatgaaggagtacaataagaaggaagccaaattctatggcaatatgtttgccaagatgaataaaacagctcccaaagaacccgcaccaatgaccatagatagcaaagcgtaggtggtggacacgtgacggtttgatgccttgggtgttttttttttttccttaaaaatgggaacagagaagttggtttgagttgcaatggattcttctgtgtccgagtacgaggattgttgacgttaaagaatgttctgtttattcttttccctttttacagaaataattattttcagcatgaggaggttccaaagatgggaattttgggcttccatttttagtgctgatatagttggacttacaacgtcaacgacagggaaaagaatggamaargraaatacaaataatttagcactcatattwacgggaactgngggggccccgg

SEQ ID NO: 561 - DNA, 2167 bp, Gossypium hirsutum
ctttttctttcttggtcttaccttagtctcttcccttcgcatctcaaagcttcccattcacactcgtttcttcgtttttgacgagctaactcactcactcactcagttactcgttttctctttggcacactcgctcgatctctctctagatttttccgattacaaatggaggatttcgatatcccggcggcggaagacatgatgaacgaagatatggatcttcccgacgagagtcccattctgaaagtcggagaagagaaggagatcggaaatcaaggcttgaagaagaagcttgttaaggaaggtgaaggttgggagtatcctgaaatcggagacgaagttgaagttcattatacggggacgttgctggatggaactcagttcgattcaagccgtgatagaggcactcctttcaagttcactctcggtcaaggacaagttattaaaggatgggatgaaggtattaagacaatgaagaaaggtgaaaatgccatctttaccattccccctgcacttgcgtatggcgagtctggttcaccaccaaccattccccctaatgcaaccctccaatttgatgttgaattgttatcttggacaagtgtcaaggatatttgcaaagatggtgggttatttaaaaagatacttattgaaggtgacaaatgggagaatccaaaggaccttgatgaagtgctcattaactatgaagctaagctcgaggatggcacagtggtggcaaaagccgaaggcgtagagttcactgttaaggatggtctattctgtcctgctttggcaagggctgttaagacaatgaagaagggggagaaggtgcttcttacagtgaagccacagtatggttttggtgagaaggggaagccagccactggtgctgaaggtgcagtgcctccaaatgccacactcttgattactttagagttggtttcatggaaaactgtgactgaagtaactgatgacaagaaggttataaagaagatcttgaaggaaggagagggatatgagcgcccaaatgagggggctgttgtccaagtgaaattgattgggaaactgcaagatggtaccatattcttgaagaagggccacaatgaaggagaagaattgtttgagttcaagacagatgaagaacaagtcattgaaggtcttgatagagctgtgttgaatatgaaaaaaggcgaagtagcactgttgactattgcacctgagtatgcatttgggtcatccgagtcaaagcaggagttggctgtggtaccgccaaactctactgtttactatgaagttgagttggtatcatttgtcaaggaaaaagaatcatgggatctgaacacccaagaaaaaattgaagctgctggtaaaaagaaggaagaaggaaatgtattgttcaaggctggcaaatatgtgagagcttctaagasatatgagaaggctgttaagtatattgattatgatacttcctttagtgaagaggagaaaaagcagtccaaggcgttgaaggttgcttgcaatctgaacgatgctgcttgcaaattgaaactaaaggactacaagcaggctgagaagttgtgcaccaaggttttagaattagaaagtgcaaacgtgaaagcactgtatagaagggctcaagcatacatcaatctggcagatttggatttggcggagcttgatatcaagaaagctcttgagcttgaccccgataatagggaggtgaagctcgaatacaaagctttgaaagagaagatcaaggaatataacaagaaggaagccaaattctatggcaacatgtttgccaagatgaataaaatggattctggtgattccagtaaatcagctgcaaaggaacccgaaccaatgagcatagatagcaaggcataggtggagatgaagcaaagcttggagaccttaatcaattaaagtgaagttgatgatccctagccttttatggtcttttaactacgtttgttctatttgcaggacaacttatctttgacatagagaatttgagttgtaatggattcgtttctatctgaggttggttgacatttaaaaaaaaagaattctgtttattggagatttattttcaatataaggggtactgtcccaaaagattgaaaacttgttggttgcttttgaggttgatatattattatgttataat

SEQ ID NO: 562 - DNA, 1141 bp, Gossypium hirsutum
ggcacgagcttggctttatactctaaaaaggtttttctgtatcactttaatggctgcatcctccccccattcacttctcatatcgtcttccttgttctatttggattctttttgggtttttcgttttttcgatcgttgtttaatttcaaacctatctcattctcagattcttagtcaaccttgtagtttctaacatataaaaaccgacggccgagaagtagtcaccaacatgggaaaacgtaaaactcagcgcaataatgcggcgatgttagatagtgacgatgataatagtagtgtaagttcatcgtcgaccatgcgttccgctggaatgtcggtttccggaactgaagaagtagagcttaataaggatagtttacttgatgaagctgtggataatttatacgaaaagaggggttcaacgcgagagaaggctttggcctcgattatcgaggctttcaacagcaacttgcagcatgagttcgtggagaagaagtttgctacattattgcaccggtgcctgaattccatcaaaaaggggtccagcaaagagatatctttagcttcccataccattggtttgctggctttaactattggtcccggagacaaagcacgggaaatattggaggaatcaatcactcctgtttcacaggcttttaagtctggttacgaatcttctaagatagcttcgttactggagtgtttggctatcatcacttttgttgggggaatcgaaccagaggaaacagaaaaatcaatgcaaattatgtggcagttggttcaccctaaactaggctctaatgttattacygtcaaascttctgctgttgtaataacagcggttgkgtctgcctggtcwtttcttttgacaactatggatagatggagtctcagtcccmaactttggctaaaatcctcacatatkkgkskagtttgctagataaggawgamcgatctkktcscwttgytgctggggaarcmctgraartaatttttarawgggaagyttwraraagtttgcymctgaactkaargktcaaawaakggttmaktttckraaggraawaaatytaaaaaggatwattacatatacaaggatkgagggcaaaaattytaaaycaartcararacctctytktgg

SEQ ID NO: 563 - DNA, 1362 bp, Gossypium hirsutum
gcctctagaacctacattcacccataaaatccctttccttgcgttcctccatttcttagcttttgaaagcttccctgttcacgctcattgttcacttgtcacgcacacattagctccctatctcttagcctcttctattcgaaatggatgaggattttgatatcccgctggtggaggatgtgaatgacgacattgatcttcccggggatgttcccaccttgaaggtaggagaagagaaggagatcggaaagcaaggcttgaagaagaagcttgttaaggaaggtgaaggttgggaaaatcctgaaaccggcgacgaagttgaagttcattatacggggacgttgctggatggaactaaattcgattcaagccgtgatagagggactcctttcaagtttgctctcggtcaaggacaagttattaaaggatgggatgaaggtattaagacaatgaagaaaggtgaaaatgctatttttaccattcctcctgagctggcatatggtgaatctggctcaccgccaaccattcctcctaatgcgaccctccaattcgatgttgaattgctctcttggacaagtgtcaaggacatttgtaaagacggtgggctatttaagaagatactgactggaggagagaagtgggagaatcccaaggaccctgatgaagtgttagttaactatgaagctaagcttgaggatggaacagtggttgcaaaagctgatggcaaggagttcactgttatggagggtcatttctgtcctgctttggctaaggctgttaagacaatgaagaaaggggagaaagtacttcttacagtgaagccgcaatatggctttggtgagaaggggaagccagcaggtggtgctgaaggtgcagtgcctccaaatgccacactccaaatcaccttggagttggtttcatggaaaactgtttctgaggtcacagatgacaagaaggttatgaagaagatattgaaggaaggagagggatatgagcgaccgaatgagggggctgttgtcaragtgaaattggttgggaaactgcaggatggtaccgtcttcttgaagaaaggtcaagatgaaggacaagaattgtttgarttcaggacagatgaagagcaagtcattgatggtcttgataaagctgtgatgactatgaagaaaagggggaaatttksccttgtttraatatttgkcyccctgaaaaacccctttttkggaatyttcccaaawtcaaaamrgggggrgckgggscttccgggyamcccccctcaacccccccccagggtggttatttttgtagggagggggtgaagaagaggggggtggttttttttttttttttgcgaggaggagaaagaaa

SEQ ID NO: 564 - DNA, 1210 bp, Gossypium hirsutum
gccataacttctgatgaagcgttgagtttgctttttatacctaagcgtgcagttgtatttggaggagggtaccttgctgttgagtttgcatcaatatggcgaggcttgggtgctactgtggatctcttttaccgaaaggaacttcctttgagaggatttgatgatgaaatgagggcagtggttgcaagaaatctagaaggaaggggaataaagttgcacccacagacaaatttgatggagttggttaaaacagatmatggcataaaagttattacagatcatggtggtgagttaatagcagatgttgtactatttgccacaggcaggttaccaaatacaaaaaggttgaatttggaagctgtaggtgttgaaattgataaaacaggagctgtgaaggtggatgagtactcgcgcactaatattcccagtatatgggctgttggtgatgttacaaatcgaatgaacttgactccagtggccttaatggagggaacttgttttgccacaactgtttttggtggcgaatctagcaaaccagactacagaaatataccttgtgctgtgtttagcataccaccactttcaattgttggtctcagtgaagaggaggcaattgagcaagtaaatggtgatgttctggttttcacatcaaccttcaacccaatgaagaatactgtatccggacggcaagaaaagacaataatgaagttagttgttgacgcggaaactgataaagtacttggggcatctatgtgtgggccagatgcacctgaaattatgcagggcattgctgttgctctaaagtgtggagcgactaaggcacaatttgacagcaccgtcggcatacatccttccgctgctgaggagtttgtaacaatgcgctctgtttcacggagggtgactgcccggggaaaagcgaagacaaatctgtagtggatgtacagcaaggtaactttggtgctggtaaactgcagtcgaatgcaacattcacatggtcgtatatatatttcacaggaaatggtattagatgatcgttgaatgcaacatcamccataaaggmccttytmccgtattttgtcatataatgtcataatgtgacttgccttttacatgattttatatatttattttgtattttattaaatagtaattttatttatgtaattgatatagaatgatgttagtaatataattaaaaggggtaacctcc

SEQ ID NO: 565 - DNA, 1161 bp, Gossypium hirsutum
gatgaaatgagggcagtggttgcwagaaatctggaasgaaggggaattaatttgcatccacagacgaatttgactgagttgattaaaacagataatggcataaaagttactacagaycayggtgaagagttgatagcagatgttgtactctttgccacaggcaggttaccaaactcgaagaggttgaatctggaagctgtaggtgtggaacttgataacacwggagctgtgaaggtggatgagtactcacgtactagcattccyagtrtatgggctgttggtgaygttacaaatcggatgaacctractcctgtrgccttaatggaaggaacctgctttgcgaaaactgtttttggtaaggaacctagcaaaccagactacagccatgtaccttgtgctgtttttagcatccctccactttctgttgttggtctcagtgaagagcaggcaattgagcaagcaaatggtgatgttctggttttcacatcamccttcaatccgatgaagaacactgtatctggacggcaagaaaagacggttatgaagttagtcgttgatgcagagactgataaagtactcggtgcatctatgtgtggtccagatgcacctgaaattatgcagggtatcgctgttgcactgcagtgtggagcgactaaagcgcaattcgacagcacagtcggcatacatccttccgctgccgaggagtttgtgaccatgcgatctgtttcacggcgtattacctgtagggggaaaccgaagacaaatctgtagacaacatatcaaggaaacttgcagccctggtgayatagaagcaacatttcttatgatcatagatatttgagagaacaggtaatatttaattggtaagggttatatttggtttgatcattattcacaataaaaggctcatctatcttctgtgtattttatgttgtatttgttaaaaatagtggccgcgaccaacgtatttttacctttgtaccttatcagcgcactgaaaaatttggattagcatcatttgagttctttagtaatgaagagttattattggactatgttacggttttagttacattgtctgttcaatatgatcatatgtttttgtagttttgtactgaatatgcgtcggaaaagaaaggaagattacacatattttataaa

SEQ ID NO: 566 - DNA, 1533 bp, Gossypium hirsutum
taattgctctgttacagtgcctcaaatctygccctgttcttaggttcctttttttcacccaatttccatcgtctttcctaaccgttcaattgaacatcccctcttttctggtctttttgttttcccatccctttctctagaaaattttgacaccaattttctcgagaaagttagggtttttacaaagacagatatagagaaggagcaatcatgagctttcaagatctggaggctggacggccatttgcgtcgaggcaaaacatgatcaacggaaagcaagacgcttcgcaagctgtggcttctggcattttccaaatcaacaccgccgtctccacattccagcgactcgtcaatacccttggcactcccaaggacacccctgagctccgagaaaaactgcataaaacaaggctacatattgggcaattagtgaaggacacttcggctaaacttaaacaagctagtgaaaccgatcaccatgctgaagttagcacaagcaaaaagataacagatgccaaacttgcaaaagattttcaagcagttttgaaagagtttcagaaggctcaacggcttgcagctgaaagagaaacttcatattccccttttgttccccagtcagctcttcctgcaagctacacggcaggggagatggatgcaagttctgataaaagtgctgaacagcgagcccttcttgttgaaagaagacaagaggtcgtgctgctggataatgagattgcatttaatgaggctatcattgacgaaagagaacaaggaattcaagaaattcagcagcaaattggtgaggtgaacgagatcttcaaagatcttgctgtgctagttcatgagcagggaactatgattgatgacatcgggacccatattgaaaattcccaggctgccacttcacaggcaaaatcccatctcgtgaaagctgcaaagagccagagatcaaattcttctctggcatgcttgctcctggtgatattcggaattgtgcttctgatagtgatcatagtactggcagcctaatcagaaagtcgtccaagatgatcaagggcaaactcaaaagatcttcccagcagcaagaatgtggtcttctgagtaatgtgtttgacgtttctttgcaagrcatgatggctgactcgagttcacttaatagtttttcaagtatatagcatgtgattatcagtaaatgataatgatatttttggttaatctttggcggagtgtctcttttctaagttggtgttttggttttttttgttgaggatgtctttacagctttcgtgttgtaataagagttgcaattttttgtttttctatataaataaatataaatatatatatgagttgtttaaaaaaaaaaaaaaaaaaaatccaaaaagaaactttaaaaagggccccgggggcccaaccaattttcccccccggggggggggaccaaggaaaatgtaaccaatttcccccctaaagggagccttaaataaaatttcctgggggcgcttgttttttaaaaacaccccgggaaggggg

SEQ ID NO: 567 - DNA, 1158 bp, Vigna unguiculata
gtcaacaccgccgtctccaccttccagagactcgtcaacaccctcggaacccccaaatacccccgagctccgcgagaagctccacaagacaagactacatattgggcaattggtgaaggatacatcagctaaacttaagcaagccagtgacattgatcaccgtgctgaagttaatgcaagcaagaagatcgcagatgctaaacttgctaaagactttcaagcagtattgaaagagtttcagaaggcacaacgtctttcagctgaaagggaaacggcatacactccttttgttccccaagcagtccttccttccagctatactgctggtgaattaggtgttggttctgataaatcaccagaagagcgtgccttactcgtggaatcaaggaggcaggaggttttgttcttagataatgagattgcctttaacgaggccatcattgaggaaagggagcaaggcattcaagaaatacagcagcaaattggtgaagttaacgagatcttcaaagatcttgctgtgcttgtccatgagcaaggaaccatgattgatgatattggctccaacattgagaactcccatgcagcaacagcacaagcaaaatctcaacttttaaaagcttcgaagacccaaagatcaaattcctctttgacatgcttgcttttggtgatttttgggattgtgcttctgatcgtgatcatagttcttgctgcttagacaaatattgtctcaattccattatgaagtaaatgcatatatacagagcagcagatatcaacttccttgctgaagatataacttgatcggtgttttgtcgggtctggtgattgactggagtttgttgcatctgatttcagttcaagatgtgagaattcccataattttgttgtggggtgttatgttctctctatatgttagtgttttggggttttcaaatatgtcacgacttatgttgtaagtcctcaccttgtttctttaattgaaaaagtattaattctttcatttcccttgtaaatgcaacactgaaactgggctggttgtgctgactcttcagtaaaaccttcgtatatggtaatatgtttctcttctagtgttttatttcccaaagtggactatatgtgtatgagaaaaatgtgatgtatttgatgagtttattctgt

SEQ ID NO: 568 - DNA, 783 bp, Vigna unguiculata
ggattcgaagatggatggaagagccgttgggttttatcggactggaaaaggagtgagggaaaagcaggtaccttcaagcacacagcagggaaatggtctggagatcctgatgacaaaggtcttcagacacataacgatgccaagcattttgccatatctgcaaagatacccgagtttagcaacaaggacagaacccttgtagtgcagtattcaattaggtttgagcaggacattgaatgcggtggcggttacatcaaacttcactctggttatgtcaatcagaagaagtttggtggtgataccccttacagtttgatgtttggaccagatatatgtggtacacagactaagaagctccatcttatactatcataccaggggcagaattaccctattagaaaggagctgcaatgtgaaacggataaattgactcatttttatacatttattctaaggcctgatgcctcttatagtatccttgttgataaccgggaaagagattcaggaagcatgtacgcagattgggacatccttcctccgaggaaaatcaaggatgtcaaagcaaaaaagccagcagactgggatggtagagagtacattgaggatcctaatgatgtcaaaccagagggatatgattcaattccagctgaaattcctgatccaaaagccaagaagcctgctgactgggatgatgatgatgatggactatggaagcccaaaaagattcctaatccagcatacaaaggaccatggaaacgcaagaaaatcaagaatcccaactac

SEQ ID NO: 569 - DNA, 1795 bp, Vigna unguiculata
tagcttgttactctcctattacgacgacgcagatttagttcaatttgttcgattgcgatggctaggaagatgcttatcgacggtgaggctgaatcggttccaggtgtagaacaagggacgaattttgacttcgacttgtttattattggggctggaagtggtggcgttcgtgctgctagattttcatcgaattacggagctaaggtgggaatttgtgagcttccgtttaatcccattagctcagaaacaattggaggagttggtggaacgtgtgttattcgtggttgtgttcccaaaaagattttggtctatggagcatcttatggaggtgaactcgaggatgccaggaattatgggtgggaattgaatgagaaggttgacttcaattggaagaagctcttgcaaaagaagacagatgaaataaacagattaaatggaatttacaagaggctgttatccaatgcgggggttaaattatttgaaggcgagggaaagatagttggtccgaatgaggttgaggtgacacaattggatgggacaaaactgtcctatactgctaagcacatattaattgcaactggtagcagggctcaacgtccaaatattccagggcaggagttgggtataacatctgacgaggcactaagtttagaggatcttcctaaaagagctgtggttcttggaggaggttatattgcagtggaatttgcatctatatggcgtgggatgggttctgaagttgatttagttttcagaaaggaacttctgctaagaggttttgatgatgaaatgagagctgtagttgcaagaaatcttgaaggcaggggaattaatttacacccaaggaccaatttgactcagttgatcaaaacagaaaatggaattaaagttattacagatcacggtgaggaactgattgcagatgttgtactatttgccactgggagggctcctaattctaagaggttgaatttagaagctgtaggtgttgaggttgacaaagctggagcaataaaggtggatgagtattcacgcacaagcatacctagtatatgggctgtcggtgatgtcacaaacagaatgaatcttacacccgtggccttgatggaggcatcgtgctttgcaaaaacagtatttaatgggcaagcaagcaagccagactacagtaatattgcatgtgcagtgtttagcattccaccactttctgtagttggtctcagtgaggagcaggcaatagagcaaaccaaaggtgatctgttgatttttacatcgaccttcaatcctatgaaaaacaccatctctgggcgacaagaaaaaactgaagtcatgaagcttattgttgatgccgagaccgataaggttcttggagcctcaatgtgtggacctgatgcacctgaaattatacagggtattgctattgcattgaagtgtggagctaccaaggaacagtttgatagcacggtgggaatacacccatcggcggcagaagaatttgtaaccatgcggacagtgacacggcgcgtaactggaagtggcaaacccaagaccaatttgtaagagtcttctttagtgaaaataatttgtgtttgatgggtagtgtaaagctgcaaattacttcctttggtgacctttctataaaatggcctttctatttgtcacatccattatatttcacattccttagtggaaacagtttggttcattatgtaacaatgttaaataaattaggacgcgtttgatgcagtgaakgacaaaatatatttagagtggaatatatttttagtcccttgaattt

SEQ ID NO: 570 - DNA, 928 bp, Vigna unguiculata
ggacaccttcttcttccctcgccaaaccacgatctctgctctcttctgcatcttctcagttgcaaagaaaaaaaaaatgtggaagaaaatgggttttgaagaagaagcagttgttgaattgatcaactctgatttcagagacctaagcgtagctgctaatcaattggcgaatcacgtggtcaaacttggtggcataggctttggagcttcttttttcggattgattgctgccattgctgctatttatctgttaattttggatcgtacaaactggaggacaaatattctcacagcactactcattccatacattttcttcagcttgccttcgataatttttgccgtcttcagaggagagattggaaaatggattgctgttattgctgttgtattgcgccttttcattccaagacacttccctgattggctggaattgccgggtgctttgattcttcttatcgttgtagctccttctctatttgcaaacacctttagaaacgacattgttggggtggtagtgtgtctcatcattgcatgctatctgctgcaagaacatattcgggcttctggtggttttagaaactccttcactaaagcccatggcatatcaaattccattggcataatacttctgttggtctatcccatctgggcgttggtggtcatacttttttaggaaccatcgcttggttgatatgtgtgaattaaaccaattgttttctctaccattcattcgttggaacttgatgtgtataagcaccttgcattgttttatgattcacctgtcgtgaagttagcccgtgtaaaaaagtggaatcaaatctctctgagatttttgggtttcatggaatgtaaaaaaacaaaagaagatgaagatgattcttgtggtattgttttagctgtcgagtattcacacgtcatgtatgat

SEQ ID NO: 571 - DNA, 1567 bp, Vigna unguiculata
gcctgagctagcatatggtgaatctggttcccctccaacaatacctcctaatgctacactccaatttgatgttgagctactttcatggactagtgtaaaggacatatgcaaggatggtggtatatttaaaaagatacttactgagggagagaaatgggagaaccctaaggatcctgatgaagtattggttaagtatgaagctcgtctggaagatggaaaactggtaggaaagtctgatggagtggagttcacagtcagagaaggtcattattgtcctgcattgtcaaaggctgttaaaaccatgaagaagggagagaaagtggttttgacagttaagccacaatatggatttggtgagaaggggaagccagctcaagctgaagaaggtgctgttccaccaaatgcatcattagagattactcttgaattagtttcatggaaaactgttacggaagtaactgatgacaagaaggtcataaagaagattctcaaggaaggggaaggatatgagcgtccaaatgagggggccagtgtgaaagtgaaactaattggtaagcttcaagatggtactacctttttgagtaagggccatgatgaagaagagaagctgtttgaattcaaaacagacgaggaacaagttgttgatggacttgatagagctgtattgactatgaagaatggtgaggttgcattgttgaccattgcacctgagtatgcttttggttcatcagagtctcagcaggagttggcagtggttcctcctaactcaactgtgtattttgaagttgagctagtttcatttgagaaagagaaagagtcctgggatctgaatactgaagagaaacttgaagctgccaataagaagaaagaagaaggaaatgtgttgtttaaagctggtaaatacgcaagagcatccaaaagatatgaaaaggctgtgaagtacatagaatatgattccgcctttggtgaggaggagaaaaagctggcgaagaccttgaaggttgcctgcaatctgaacaatgcagcttgcaagttgaaattaaaggactataaagaagcagaaaagttgtctaccaaggtgttagaccttgagagtacaaacgtgaaagccctctatagaagggcccaagcatatatgcagctgagtgacttggatttggctgaacttgacattaagaaagctcttgaaattgaccctaacaacagggatctcaaattggagtacaggactctgagggaaaaggtgaaagagaataatcgaaaggaggcgaaattttatggaaatatgatcaacaagttgacaaagattggttcctgatagcaataaaccagctaccaataatggtattcaatccgtgggtatggtgaatggcatccaaaatggaacgagatgtttagcccctcgttttctgggtttgctcttcgtggtatggtgatatggtatgtgcctacggagatttgatggttatttattttggatttattatcgaagttgacataattgacttacacaattaatgatttgtacgagaactacagctagaaatgtaattgattgtattgtgtt

SEQ ID NO: 572 - DNA, 1845 bp, Taraxacum officinale
accaaaacatggttttgaattctccatctgaaattaaccacgattgctcatctgtcgtggcaaattgatattcaaacccttaaattcggaaggggattaactttaatttctccacgagcaagtaaaacccctgctggagatcaagtttagtacgttgttcagctgaagcaagtattctaatcatgtcgaggaagatgctaattgacggggatttggatgatactactggagatattgattacgattttgatttgttcgtgattggtgctggcagtggcggtgttagggcatccagattttcagctcagtatggagctaaggttgggatatgcgagctgccatttcacccaatcagcacagaagttgtaggaggtgttggaggaacgtgtgtgattcgtggatgtgttcctaaaaagatcttggtctatggagcaacctttggtcctgaaattcaggattcaaaggagtatggatggaaagtgaacgacaacattgattttgattggaaaaagctactacacaagaagactgaagaaatagtgaggctgaatggaatatacaagcgcttactttcaaatgcaggagtcaaactatttgaaggggaaggtagaattgtgggacccaatgaagttgaagtgatacaattagatggcactaaattgtcctattcagcaaaacacatactcatagcaactggtagcagggcacaacgtcctaatattcctggatgggagttggctataacttctgatgaggctttgagcttggaagagttaccaaagcgtgtagttatacttgggggaggatatattgctgttgaatttgcttcaatttggcgtgggatggggtccacagtgaatctatgtttcagaaaggaacttccattaaggggttttgatgatgaaatgagagctcttgttgcaagaaatcttgaaggaagaggcataattttgcacccacaaaccaatataacacagttggtgaaattggaagatggcagcataaaagttactacagatcatggtgaagagttaattgcagatgttgtactttttgccaccgggcgggccccgaataccaagaggttaaacttggaaagtgtaggggttgaacttgacaggagtggagcaattaaggttaatgaatattctcgcaccaatgttcctagtatttgggccataggtgatgtcacaaaccgcataaatcttactccagttgctttaatggaaggaactttctttgctaaaaccgtatttggtaatgaacccagcaagccggattacagcaacgtaccttgtgccgttttctgcataccaccactctctgttgtgggactaagtgaagaacaggcgatagagcaagcggaaggcgacattttggtgttcacatcaacattcaatccaatgaagaactccatttccggacgacaagagaagtcactcatgaagcttattgtgagtgccgagacagataaagttatcggcgcgtccatgtgtgggcccgacgcagcagaaatcatgcaggggattgctgtggcagtgaagtgtggagcaacaaaggcacagttcgatagcacgatcgggatccacccgtcgtctgctgaggagttygttaccaygcggtccgtcacacggaggatcgctgcctccgggaaacgcaaaaccaacctttaagaacgtttgactttgaccacacatggggtatacttttgcttcatttttattatcagcgtatgaataatgtggatatttcttggstcttttgataaagatttggggtagatttgttgcatgttggatttggagttgaaggaaaataggaaatgaattgcatttgtgttcgacg

SEQ ID NO: 573 - DNA, 988 bp, Taraxacum officinale
gattcttcccatagttgtcgccatttcttcactagccccacctccgattacccttcactttcactcactctctttccattactcccttctccgatcgaaattgctcttcgttccataatcgaattcattcwtcrmtttagggctcgktccgsaaatttaatatgagttttcmagatattgaagcgggtcgcccgctcaattctcgccgtgcmggctacacggggatgaagyaacragacccaacmcaakccmttrcttatggaatcttccagatcaayactgctgtatctacgtttcagaggctagtaaataccatcggtacccctaaagacacccccgagcttcgagacaaactgcacaaaacaagactacatattgggcaactggtgaaggacacatctgagaaactcaagcaagctagtgaagcagatcatcgtactgaagttagtgctagcaagaagattacagayrytaaacttgcaaaagattttcaagcagttttaaaagaatttcaaaaagcacaaagactttcagctgaaagggagacagcttactctccttcagttcctcaacccattcttccctcccgtaatgaagccagtgaagatgcaagctcaggaacaagtccagaacagcgtgcccttcttgtcgatagaagrcaggaagtgttgttattggacaatgagattgcgttcaatgaggctataattgaggaaagagatcagggaattcaagaaatccaaaaccaaattggtgaagtcaatgaaatattcaaagatcttgcggttttggttcatgarcaaggaactatgatcgatgatatcgggtcaatatcgagaactctcatgctgcaactttacaggsaaaatcccatcttgctaaagcatcaaagactymaaaatcaaactcttccatgacttgcttgctttttgtgatcttagggattgtgcttctgattgtgatcatattacttgcggtctgatcttca

SEQ ID NO: 574 - DNA, 1047 bp, Taraxacum officinale
cggggcggcattctccccamrkkgcgctaacaattcttcacaaccctcacgccgattgctaaacctacaaataatcttcaccctttcgatcgagaccctgctcgatcggtagggtttttcatctcaatcgaattattcgcatcaaatctcgaaagtctagggtttattcgtcggatacatcggagagatataattagataagatgagctttcaagatcttgaatccggtcgtcagttcaattcaaagcgagatggatacactaatggcgtcaggaaacaggatccgactcaagctattgcttccggaattttccagatcaataccgccgtctctacgtttcagaggctagtcaatacccttggtacacctaaagatacccccgaacttcgagaaaagctgcacaaaacaagattacatattgggcaattggtgaaggacacttcagaaaaactgaagcaagcaagtgaaacagatcatcgtgctcaagttactgcgagtaagaagattacagatgcaaaacttgcaaaagattttcaagcagttttaaaagaatttcaaaaagcccaacgccttgcagctgaaagagaaacagcttacactccttttgttcctcaagctgttcttccttcaaggtaatgtaaatttatctgacccttgaaaaattaaatttatgattatgattatgcttttttatttgcagttatgctgctagtgaaatggatataagctcagataaaaacccagaacaacgtgcacttcttgtggaatctagaaggcaggaagtattgttattggacaatgagattgcgtttaatgaagcgattattgaggaaagagaacaggggattattgaaatacaaaaccaaataggagaagtaaatgagatattcaaagatcttgctgttttggttcatgaacaaggagccatgattgatgatattgggtcaaatattgagaactctcatgctgcaacttcacaagcaagagtccatctttcaaagcatcgaaaactcaaagggcaaatycgtcatgacttgcttgcttat

SEQ ID NO: 575 - DNA, 949 bp, Taraxacum officinale
gtgtacctttttcggatcgccggcaatgcaatacctggctcttccaccaccaccacatccttcccctgtaaatcatttcatttctctcacctcaakcggsgscataatttacaatttcgatcaatacctactacgatcacgttagcagaacaaggtttcagtaattaacggctttgatcgagaccctgctccgatcggtagggtttcatctcaatcggaattgttctttgttttaggattgtgtaatttgaggatcatcgtagagagatacaagataatacaatgagttttcaagatatcgaagctggtcgcccgctcaattcgagacgcgggggctacaacaatggcatgaggaaacaggatccgactcaagctgttgcttctggaattttccagatcaatacggcagtctcgacgtttcagaggctagtgaatacccttggtactcctaaagacacccctgagcttcgagaaaagctgcacaaaaccagactacatattggccaattggtgaaggatacgtcagataaactcaaacaagcaagtgaaacagatcataacactgatgttagcgccagcaaaaagatcactgatgcaaaacttgcaaaagattttcaatcagttcttaaagaatttcagaaagcccaacggctttcagctgaaagggaaacagcttacacaccttttgttcctcaatcttctcttccttcacgtgatccagacagtgaaatggatgtaagctcggacaaaattcaagaacaacgtgttcttcttgtggactctaaaagacaggaggttttgttgttggacaatgagattgcatttaatgaagcgatcattgaggaaagagatcagggaatacacgagattcagaatcaaattgagtgagtacatgaaatttttcaagatcttgctgttttggttcatgaccaaggagccatgatcgatg

SEQ ID NO: 576 - DNA, 979 bp, Taraxacum officinale
cggggcggcattctccccamrkkgcgctaacaattcttcacaaccctcacgccgattgctaaacctacaaataatcttcaccctttcgatcgagaccctgctcgatcggtagggtttttcatctcaatcgaattattcgcatcaaatctcgaaagtctagggtttattcgtcggatacatcggagagatataattagataagatgagctttcaagatcttgaatccggtcgtcagttcaattcaaagcgagatggatacactaatggcgtcaggaaacaggatccgactcaagctattgcttccggaattttccagatcaataccgccgtctctacgtttcagaggctagtcaatacccttggtacacctaaagatacccccgaacttcgagaaaagctgcacaaaacaagattacatattgggcaattggtgaaggacacttcagaaaaactgaagcaagcaagtgaaacagatcatcgtgctcaagttactgcgagtaagaagattacagatgcaaaacttgcaaaagattttcaagcagttttaaaagaatttcaaaaagcccaacgccttgcagctgaaagagaaacagcttacactccttttgttcctcaagctgttcttccttcaagttatgctgctagtgaaatggatataagctcagataaaaacccagaacaacgtgcacttcttgtggaatctagaaggcaggaagtattgttattggacaatgagattgcgtttaatgaagcgattattgaggaaagagaacaggggattattgaaatacaaaaccaaataggagaagtaaatgagatattcaaagatcttgctgttttggttcatgaacaaggagccatgattgatgatattgggtcaaatattgagaactctcatgctgcaacttcacaagcaagagtccatctttcaaagcatcgaaaactcaaagggcaaatycgtcatgacttgcttgcttat

SEQ ID NO: 577 - DNA, 561 bp, Festuca arundinacea
ggcacgaggctgaactatctatttgtcaaggcaatgtatgccggaacttcaatatctgctggaatgaaaggcgcaagcaaagcgatggcagcaatgaataagcaaatggaaccgacaaagcagatgaaggtcatgagagaattccagaagcaatcaactcaactggacatgacgctcgagatgatgtctgatgcagtcgacgaaacactagacaaagacgaggctgaagaggaaacagaagagctcacgaaccaggtaaaatgctaactatattctgctccagagggcatatcatagaactgttctcgtaagtacgtgtttcatgccatttccaaaaagaaaagaaaaagtataagggcgaatttggatctattggcaagatcttgtgctttttgatgaggttgccaccgttggcaaagctagcagggctaataatccccccccccccctcctgcatcatagtattgagacgttcactaattctttcatgatatgtgatgcccatgatgcaggttctggatgagattggagttgatgtggcttctcagctctcttccgcac

SEQ ID NO: 578 - DNA, 451 bp, Festuca arundinacea
ggcacgaggctgcactattgcaagaaccacaggcaggtgttaatcagagcaaagaaagacagggagatgacaatgaggccgctcatctttcttgccttggccgtcctgctcgccggtgtcgcgctggaagggggcgctgaggctgccggcgagtgcgggaggtcctcccccgaccggatggccctgcgaatggcgccatgcatctcggcggcagacgacccggagtccgcaccgaccggcagctgctgctcggcggtgcacaccattggcaagagccccagctgcctatgcgccgtcatgctgtccggtaccgccaagatggccgggatcaagcctgaggtcgcaatcagcatccccaagcgctgcaacattgccgaccgccccgtcggctacaagtgcggagattacacgctgccttgataacgcagctttgctaccgatcgaacgaatg

SEQ ID NO: 579 - DNA, 650 bp, Festuca arundinacea
ggcacgaggccaacccgaaccgcgaccgctcctccttcccctcttaccacccatgggctcgtcggaggccgacgacgacctgctcctcaagagcttcctggccgaggtcagcgaggccgagcgcgacaacgaagtcctcagaatacttggttgcttcaagttaaatccttttgagcatcttaagttgtcatttgattcttccccggatgaggtgaagaagcaatataggaagttgtcgttgttggtccatcctgacaaatgcaagcatccacaagcacaagaagcttttggagccctgtcaaaggcacaacagctcctacttgatccacaggaaagaggttacattcttgatcaagttactgctgcaaaagaagagctgagggcaaagaggaaaaaggagttgaggaaagacagtgcatccaagataaaatcccaagtagatgagggaaaatacgaagatcaatttgaaaggtcggacgaatttcataagcagctaataattaaagttcgtgaaattttgacggacaaagaatggcgccggagaaaaatgcagatgaggatatcagaggaagaaggaagactgaagaaggacgaggaggaaacaaaagaaatgtggaagagaaagagagagcatgaagagaagtgggaag

SEQ ID NO: 580 - DNA, 959 bp, Festuca arundinacea
ggcacgagggagaatatcaccatcgcgtcagcgctgataaccaaaagctttggggacaggctcaggaaagcagtcgaaaagggcgacatggttaatgtgaatttggattggagggagtccctgcctcaccctgatgagcgkgtcgagtaygaattttggactaacagtaacgatgagtgtggtccaaaatgcgacagccagattgatttygtcaagascttyaaaggaccrgcgcagatacttgagaagaaaggttacacacagttcactccycattacattacctggtattgcccagagtccttcacgttaagcaagcagtgcaagtcccagtgtatcaaccacgggaggtactgtgcgcctgaccctgaacaggatttcagcaaagggtatgatgggaaagatgtggtggttcagaatttacggcaagtttgtgtttatcaagttgctaaggacagtcagaaaccctggttgtggtgggactatgtgactgattttgcaattcgctgcccaatgaaggaaaataagtacactaaggaatgtgctgatggagtgatcaagtcacttggacttgatcacaaagcgatagataagtgtattggtgatccagatgctgatgaagaaaatcctgtgctgaaagccgaacaagatgctcagattggcaaaggcgcttgtggtgacgtcactatcttaccgacactagtcatcaataataggcaatacagaggaaaacttgacaaaggagcagttcttaaagcactttgtgcaggttttaaagaaactactgagcctgctgtttgcttgagtgaagatatacaaacaaatgagtgtttggagaacaatggtggctgttggcatgataaggctgctaacatatctgcatgcaaggatactttccgtggaagagtttgcgaatgtccggttgtgaaaggtgtaaaatttgttggtgatggctacac

SEQ ID NO: 581 - DNA, 603 bp, Festuca arundinacea
ggcacgaggctccagacgaccagccgccccgcaaggtcgatctagggtttcttcttctctggacgagcarcacgccacgcgaagcagctagatactarcaccrgcgtygatggcggcggcggcaccggcggacccgaaggcggaggccgccaagatggayctcctcgaggacgacgacgagttcgaggagttcgagatcgaccaagaatgggatgacaaggaagatggtaacgaagctgtccagcaatgggargacgactgggaygatgacgatgtgaatgatgatttctcgctgcagctgaggaaagagctggaggaaggcagcgctccsaagaactgaactactayccaagcaatgtcaagctykcstacacyyatcttygttcaggcactgtgtrcmcattgctttctgaactgcgatgkctttgtatcgtacatgtagttatgtggctgtgagcagctaatttctgcaactgtgatagyggttcgtggacatrkcaaatcccataaagatctttgtcctagcactacatgggtcttcatcagtctatcgaacatggacatccttgtgcttctatcaaacgtgggcaagttggtgacgct

SEQ ID NO: 582 - DNA, 1017 bp, Festuca arundinacea
ggcacgagggtacattcaagcacacggcaggaaaatattctggagatcctgacgacaaaggcattcaaacaacactagatgctaggcattttgctatctcggccaagatcccagagttcagtaacaagggccgaacattggtgctccaatactctataaagtttgagcaagacattgagtgtggtggcggctatattaagctaatgtctggctatgtaaaccagaagaaatatagtggagacactccgtacagtttgatgtttgggccagatatatgtgggactcagacaaagaagctgcatcttatactttcttaccaggggcagaactatcctgtcaagaaggatctacaatgtgaaactgacaggttgacgcatgtttacacattcattcttcggcccgatgcatcttatagtatacttgttgataaccgtgaaagagaatctggtagcatgtatactgattgggacatcttacctcctcgtaaaattaaggaagttaatgccaaaaagcctaaggattgggatgacagagagtacattgaggatcctgatgaagttaaaccagagggctatgattctattccgagagagattcctgacccaaaggacaaaaagcctgacacatgggacgatgatgatgatggcatttggaagcctagaaggataccaaatccagcatacaaaggacaatggaagcgcaagaaaattaagaaccctaactacaagggtaaatggaagatcccatggattgataatccagagtttgaggatgatccagatttatacgtactgaaacctgtgaagtatattggaattgaagtttggcaggtaaaagctggttcggtttttgacaacattctcatttgtgatgacccggagtatgcaaaaagagctgctgaagaaacatggggtgcaaataaggaggctgaaaaggaggcttttgaagaagctgaaaaggagagaaaagctagagaagataaggaagctcaacaggcaagggaggaaggagagcgac

SEQ ID NO: 583 - DNA, 618 bp, Festuca arundinacea
  misc_feature (62)..(62): n is a, c, g, or t
  misc_feature (529)..(529): n is a, c, g, or t
  misc_feature (543)..(543): n is a, c, g, or t
ggcacgaggcaaccgcgagcgcgagcaggtcggctagggtttcgattcctcccgcggcgtanagagggaaaggggagatgacgacggcggcgcggccgacgtgggcgccggccaagggcgggaacgagcagggcgggacgcgcatcttcgggccctccgggaagtactcctcccgcgacctcgccgcccacacctccctcaagcccaggaaagagggacagcaaactcaagaggaggtgcagaagaggaatctcagggatgaacttgaggagcgtgagcgcaagcacttctcatccaaggataagtcctatgttgacgagagggattggcgaaaaagttcaggcctgctcttagaaggttcaaaacgggacgaagataagatagttccacgggaaattgatgcagatgactctgacgtggagctcagaagtgacgatgaaagtgatgatgatgatgacgatgatgacactgaggctctaatggcagagctcgaaaggatcaaaaaagaaagagctgaggataagcttanaaaggaccgccagncagcagaagaagaggccaagatgaaggaggctgagctgatgcgaggaaacccgctgatcaacatgaataatgctg

SEQ ID NO: 584 - DNA, 1235 bp, Festuca arundinacea
ggcacgagggagccaaggttgcgatctgcgagctcccgttccaccccatcagctcggaatggctcggagggcacggcggcacgtgcgtgatacgtggctgcgtccccaagaagatcctcgtctatggggcatccttccggggcgaatttgaggattcgaagcagttcgggtgggagatcagtggggacatcaactacaactggaaaaagctgctggaaaacaagactcaagaaattgttaggctgaatggagtatacaagaggatccttgggaattctggcgtgacgatgatcgaaggggcagggagtatagttgatgctcacactgttgaggttacccagccagatggttcgaagcagaggcacactgccaagcacatactgattgctactggcagccgggcaacgcgggtcaacatccctggaaaggagcttgcgattacctcagatgaggctttgagtttggaggagctaccgaaacgtgctgtgattcttggtggyggatatattgctgttgaatttgcttctatctggagagggttgggtgctgaagtagacctgttctatagaaaagaacttcctctaagaggtttcgatgatgagatgagaacaattgttgcaagtaaccttgagggaaggggaatcagattgcatccagggacaaatttaactgagttgagtaaaactgcggatggcattaaagttgtgacggataaaggagatgagctcattgcagatgttgttctgtttgctacaggtcgtgccccgaactccaataggctgaacttggaagctgttggtgttgaggttgatcaagtaggakccatcaaggttgatgagtactcccgtacatcagttcccaatatatgggctgtgggtgatgtaacaaatcggattaaccttacacctgttgctctcatggaggctacttgcttttctaaaactgtgtttggtggccagcctattaagcctgattacaaagatgtaccttgtgctgttttctgcattccgccactatccgtcgtgggtctcagtgaacaagaggctttggcggaagccaagaatgatattcttgtttacacatctagtttcaatccaatgaagaacagcatatccaaacggcaggagaagtctgtcatgaaactggtggttgatgctgagactgataaggtacttggtgcagccatgtctggaccagatgcagctgaaattatgcagggcattgctgtcgcactc

SEQ ID NO: 585 - DNA, 918 bp, Festuca arundinacea
ggcacgaggcctcgacgacgacgacgacgacctccgccgcgacgacgatgagccccttccgtggcgccctcctcgtcctcgccgtcttcgtggccgcgtgcctcggcgcggcggcggcggatcagcccggatccgctgaggggtacaccatcgccggccgsatcaagatcgacgctgcaagtgcaaagggctttggtcttccagccaagacatcgaatacaaaagtgatacttaatggtgggcagaaggttacattcgccaggccagacggatactttgctttccacaacgtgccagccgggactcatttgattgaagtctcctcacttgggtacttcttttcaccagttcgagtggacatcagtgccaggaatcctgggcacattcaagcagcattgactgaaaacagaagagttctaaatgagcttgttttggaacctctgaaagcagagcaatactatgaggtgagggagccattcaacattatgtcacttctgaagagcccgatgggtttgatggttggtttcatggtcctaatggtcttcgttatgcccaagatgatggagaacatagatcctgaggagataaagcaagctcaagaacaaatgaggaactcacctgtyccatccttttctggtttactggccagagcaaacagctagatgtacaacatgtgtacaaacgtgtggtttgagtttgtggtgctgtactgaacttgttcacgctcaagtcaaattatcttttcctgggaggcttggacaaggtggaaactcctttgcccatttttactgtattttaaaatgtaataggttgtagcacagaaccttctgagtcctgaaacatctggcttatgtagtcatgtattattgatttataggtcacatcaaattcacgtgtcgattttttaaccatttaaaa

SEQ ID NO: 586 - DNA, 651 bp, Zingiber officinale
gcacgagggctaaacaagagcttaaggtaaagaagaaaaaagagctgaagaaagataatgcttctaaaataaaagcaatgctagatgaggggaaatctgagcagcagtatgaacaatcacaagagttcaagcaacagttaaaaattaaagtgcgtgaaattttaactgaacaagagtggaggaggaggaaaatggcaatgaggatatccgaagaggaaggaagactgaagaaagatgaagaagaaacaaaggagatgtggaaaagaaaacgtgagcatgaggaacagtgggaggaaacaagagataaacgagtttccagctggagagatttcatgaagaccggaaagaagggtaaaaaaggtgagatacggcctcccaaactgaagacagaagatccaaacaagtcttatgtgcaaaggccagtaaatcgaggttgagaatctcacgacaacaatatctgataagtctgccatgctggattcagttaaatgttatatttactccggttgttaagtcgttaacattaattggagttgtacactggagttgcaaagctaattagtactcccttatttccatttgccagttgctttgtgcgccagtttggatgattgaatcatttgctggtctttgactggttgttataaaaaa

SEQ ID NO: 587 - DNA, 873 bp, Vitis vinifera
ctttgagtatcttaacatcccctttgattcttccccagatgatgtgaaaaagcaataccgtaagttgtctttgctggttcaccctgacaagtgcaagcacccacaagctaaagaagcattcggagcattagcgaaggcccagcagttattacttgatcctcaagaaagagagtatcttcttagccaagttaatgcagcaaaagaagagcttagggcaatgaggaagaagcagctaaagaaagataatgcctctaaaataaagtcattagttgatgagggaaaatatgaacaagaatatgaacgatcagaggagttccaaaaacaactaaaattgaaggttcgagaactactgacagaacaagaatggcgacggagaaaaatgcagatgaggatatcagaagaggaaggtagattgaagaaagatgaagaagacacaaaagagatgtggaaaagaaagcgtgagcacgaggagcagtgggaaggaacaagagaacaaagggtttccagctggagagatttcatgaagactggaaagaagggtaagaaaggagagatccgaccgccaaagctgaagacagaagaccccaacaaatcctatgttcaaaggccagtgaagcgaggttaactggcatgattttttgcgtttggatgggctctgctctaaagctataaacaagattttttagcaatccatgttgtgtctataaaataagttttattgttctcttttacctcacttaatcacattcctctccatggaagatattgacaaggacaattaaggagagattatacaatgcatttaacaaatttatgtctaggaatttagcctcctgaagaatcagttacttctgctaggagtttttctttctt

SEQ ID NO: 588 - DNA, 1105 bp, Vitis vinifera
atttcaaatgcttgcacctcctcctgaaggtacctttgaccttgatgaacaacatcttcccatcaagggctgtccaaaggatggctcccctgagcaagttccgttacttacacaggaggttttatcatctgatctaaatgcctcaaaacaagggaagattaaagattttttggtttatatgtatgataaattgaagatcaagcaaattcttcaaccgcctattattgcttctatcctagcattggcaattggtgcgattccatttttgaagaagctgatctttacacccaatgctccgcttttcttcttcactgacagcctcattattcttggggaggccatgattccatgcattttgttggcattgggaggcaacttggtcgatggaccaggaagttcaaaacttggtctacggacgactactgctattattttcgggcggttggttttggttcctcctgctggaattggcatagtcttgctggctgataagcttggctttctcccccctgatgacaagatgttccgatttgtcctcctcctccaacattccatgcccacatctgtgctttctggtgctatcgccaatttaagagggtgcggaagagagtcagctgctgtcctcttctgggttcatatctttgcaatcttctccatggctggatggatcgttctttatctccatatcctcttctgaaaccgcaacataccatcatcttgctgctttgggattctttaacaggaagcatgaagcatgaaagtatatatcacctacattgcggtattaatgagcagctcctatcttggtaagagctgtgaaagaagcgctgaggaggggctccttgttaattgatggatgtttcgaccttaaatcagccgttggttgttcattttaactgtttatgatttttttatttttcaacgagttggagtttgatcttttgtgcattttacaccagggatataaggttgtttgaagcctcagcctcagcctgagtagatgtgtagttcatagtgaacttctgaaagattttgcccacatcctaaaactctatttagttatttttaagctttgttgaaataagtgaaaaaaaaaaatttgagg

SEQ ID NO: 589 - DNA, 1805 bp, Carpobrotus edulis
gcacgaggattgatggcgaagccgcgatgcagagccaatctaatgacgaagacaacaacgctcactatgacttcgacttgttcgtcataggcgccggaagcggcggtgttcgagctgctcgattctcagccaaatttggtgccaaggttggtatatgcgagctcccgtttcatcccattagttcggaagtgattggaggtgttggtggaacatgtgttattcgtggttgtgtcccaaaaaagattttggtctacggcgcatctttcagtggtgaacttcaggatgcacggaactatggatgggaattgaatgaaaatattgatttcaattggaaaaagcttctgcagaagaagacagacgaaatactcagacttaataatatttacaaacgattgttgtcaaatgctggggtcaaattgtatgaaggggagggaaagatagtcagtcccaatgaagtccaagtaactcagttagatggcaccaaattgtcttattcagcaaagcacatattgattgccactggtagccgagcccagcgtcctgacatccgcgggcaggagttggcaataacttctgatgaggctttgagtttagaggaactcccgaagcgtgctgtgatacttgggggcgggtacattgctgttgaatttgcttccatatggcgtgggatgggtgcaactgtagatctgttcttcagaagggagcttcctttaagaggctttgatgatgaaatgagggctgtggctgccagaaatttagaaggcaggggagttaatatgcatcccaggactaatcttacagagctggtgaaaactgatggtggtattaaagttcgtacagatcatggtgaagaattgatggcagatgttgtgctctttgcgactggtcgttctccaaacacgaagaggttaaatctggatgccgttggtgtcaacgttgataaaacaggagctattaaggttgatgactattctcagaccagtgtaccgagcatatgggctattggtgatgttacaaaccgaatgaatctcactcctgttgccttgatggaaggaacttgttttgctaaatcactatttggtggccagccaacaaaacctgattacaaagatataccttgtgcagtgttcagcataccaccgctttctgtggttggtcttagtgaagagcaagcaatagagcaatcaaatggagacgttttggttttcacgtcatcattcaatccaatgaggaatactatctcacagcggcaagaaaagtctgttatgaagcttgttgtcgatgctgagacagatagagttcttggagcgtccatgtgtgggccagatgcacctgaaattatgcaaggaattgctgtagctctgaaatgtggagcaacaaaggcacagtttgatagcacggtatctcgataattctcttctacctctggcataaatagttcttggccttccccgttctcttgtacttcctcgatctcctgctaatccgtgattatttaaatatgatgtgaagacataggaggtgggagttaagggggcaaaggaggcctgataggttcaacttatgagtgagagagaaaacaaagaggattgcaatggcagtgcctcacagcattagtgggcagaggaggatatggttgtggtccatgagaattgttgtgttagatgttgggaaaggaggagtgaatgaggatagataggagaaatttagtataactaaaatggaaattaaaagtgcaatttctatgaatgtcaaccaaacaagtttattgcaagtatgagtggttatgatattgataatgaaag

SEQ ID NO: 590 - DNA, 748 bp, Carpobrotus edulis
  misc_feature (573)..(573): n is a, c, g, or t
actttctgagcgacaaatattggttgaagagagagaaaagggaaaaaaatcaaaattcaaagatcaaaaaaatcagaaaatgggtgtgcaagaaaaagatccgttggctcaattgagcttaccaccaggtttcagattttatccaactgatgaagagttgttggttcagtatttgtgtaggaaggttgctgggcatcatttctctcttcaaattattgctgagattgatctctataaatttgatccttggattttacctagtaaagccatatttggggagaaagaatggtatttctttagcccgagggataggaagtacccaaatggatcccgacccaatcgggttgccggttcgggatactggaaggcaactggaactgataaggtgatcaccacacaagggagaaaagttgggatcaagaaggcgctagtgttctatattggtaaagcgcccaagggtaccaagacgaattggattatgcacgagtatcgtctcaccgaacccacaagaaaacacggtagctcaaagttggatgattgggtactatgtagaatctacaagaagacgtcggnggcggccgcagcggccgctcggaccgagtcgagcaaggagcaaagcacgggcgggtcgtcctcttcatcatcgtcacatcttgatgacgtcatggaggtcgtgtcgttgccggagatcaacgaccgttcattcgcgctcccccgaatgaactcgcttaaaccgcgggtcaacccg

SEQ ID NO: 591 - DNA, 818 bp, Ipomoea batatas
  misc_feature (743)..(743): n is a, c, g, or t
  misc_feature (751)..(751): n is a, c, g, or t
  misc_feature (798)..(798): n is a, c, g, or t
ccgggggtccccttcttctctctctctctctctctctctctctctctccctttaaatccaatttgattctctcctccttcatcttccatcaattattrcctcaattttcgcccctttttctmctcctgccctaaattctaaccaccccccmaattttcttttatwattttctttttcttctagggttttcacgatcgtctctgtccaagattcaatctgaattctccyttctgtaaagatcgtctgttcggggcwtctttttcgggggtttcaggacgtatttcatccaaggagatgagctttcaggatctggaatcgggtcggsctattgggtctcgtcgggawtactccaatggcaaacaagaccccactcaggccgtcgcttctgggattttccagatcaacaccgccgtctccaccttccacaggctcgtcaataccctaggtaccccaaaggacacccccgagctgcgcgagaagttgcacaagacaaggctacatattggacagttggtgaaagatacatctgccaaactaaagcaagccagtgaaacagatcatcgcagtgaagtcagtgctagcaagaaaatcactgatgcaaaacttgctaaagattttcaagctgtmttgaaagaatttcagaaggcgcaaaggcttgctgctgagagggaaacagcatatacaccttttgttccccaggctgtccttccttctagttatactgccagtgagatagatgttanttcatacnataatccatagcaacgagctttgcttgtggaatcacggagacaatangttttacttttgggacaatg

SEQ ID NO: 592 - DNA, 446 bp, Ipomoea batatas
tcgaagttttctacaggattccgaagcgaagaacccttctctaaatctctccagcagtgcgattagggattgactgtaggatggctaccgagcaaccaaaaccggcgcctgaagacgtgaaaatggatctcttcgaagatgatgacgagtttgaggagtttgaaattgaccaagagtgggaggacaaagaggaggggaaagaagtaacccagcagtgggaagatgactgggacgatgatgatgtcaatgacgacttctccctgcaacttagaaaggaattggagtgcaacactgagaagaaggactaagctaatactctgtaatasyttggcatcattkcatgyccctctagaattaatgtgttcctcatatattgtactccactttattcttgctgaatgcttggaccttcaaytttctrttmactgtttttatcaatatggtta

SEQ ID NO: 593 - DNA, 770 bp, Ipomoea batatas
ttccaatgaaggctcctaatagagatagctcccatgctgctgcaaaggatagctcccctgagcaaattccattgcttgcacaggagcctgcagttcctgtgtcaactagttcacagaaaaataagattaaggagttcttcaagtttctgtatgaaaaattgaagctcaagcaaatcattcaaccccccataattgcttcggttcttgccattttcctaggatgcgttccattcttcaagaaactgatcttcacttcagatgctccattttacttcttcactgacagctgcatgattcttggggaggccatgattccctgcatattgttggcattaggaggcaatcttgttcaaggtccaggaagttcaaaacttggtttacggacaactgctgcaatcatatttggtcggctggttttagttcctccaactggacttggaatcgtcatgttggctgataaactcggcttccttcctgccggtgacaagatgttcagattcgtcctcctcctccagcatacaatgcccacatccgtgctttccggtgcggttgcaaatttgagagggtgtgggagggaggcagctgctgtcctgttttgggttcatatctttgctattttctcaatggccggttggattatcctgtatctcaacatattgttttaagtttgtacgtagttttgccaggaaaattaccatgcccagtgatcacttgtttatagagtaagcattattgcgagtatcgttttccataatacatactttgaaata

SEQ ID NO: 594 - DNA, 1218 bp, Lactuca sativa
cgcgggggatatcatatatcattgcttttgcggcaattctcccccaaattgcgctaaataattcttcatcaaccctcacgtcacgccgattgccaaacccgcttacaatcttcaccctttcgatcgagacagaccaccctgctcgatcgttagggtttttcatctcaatcgaataattctttgtcgtaggattcgcatcaaatctccaagtttagggtttattcgagggatacacaagttattaggtataaggtaagatgagctttcaagatcttgaagccggtcgccaattcaattcaagacgaggggcatacgcaaatggcgtcaggaaacaagatccgacccaagctattgcttccggaattttccagatcaacaccgccgtctcctcgtttcagcggctagtcaacacccttggtacccctaaagatacccccgaacttcgagaaaaactgcacaaaacaagactacatattgggcaattggtgaaggatacttcagagaaactcaaacaagctagtgaaacagatcatcgtgctgaagttagtactagcaaaaagattacagatgctaaacttgcaaaagattttcaagcagttctaaaagaattccaaaaagctcaacgcctctcagctgaaagagagacagcttacactccttttgttcctcaagctgttcttccttcaagttatgcagccagtgaaatggatataaactcagacaaaaaccctgaacaacgtgcacttcttgtggaatctagaagacaggaggtattgttattggacaatgagattgcttttaatgaggcaataattgaggaaagagaacaggggattcaagaaatacagaatcaaattggggaagtaaatgagatttttaaagatcttgctgttttggttcatgaacaaggagccatgattgatgatattgggtcaaatattgagaattctcatgctgcaactgcacaagcaagaatccagctttcaaaagcatccaaaactcaaaaagcaaattcttcaatgacttgcttgcttttggtgatagtgggaattgttcttctgattctgattacaatacttgcattttgagcctaaaagattgtacaagtattgattgtgtgattacaataaatataacctacttgaaaattatatttgtttgcagggattctttctgtaaaattaacaatttcattggttcatcttccttgtttttcac

SEQ ID NO: 595 - DNA, 1022 bp, Lactuca sativa
tcacatccccttcacctctaaattatcatcgggcccctttgaattctcccacatcagttgttgccatttctttcaccaacccaacctccgattaaccttgagtttcactctcttacgatcactcccttctcggatcggtagagtttctgtcccgattggaattgttcttcgttccataattgaaatcaaaattgttcaatttagggttcattcgagggatttaatatgagttttcaagatattgaagcgggtcgcccgctcaattctcgacgcgcgggctacacgggcatgaagccacaagacccaacccaagctattgcttctggaatcttccagatcaatactgctgtctctacgtttcagaggctagtaaatactcttggtacccctaaagacacccccgagctccgtgaaaagctgcataaaacaagactacatattgggcaactggtgaaggatacatctgaaaaacttaagcaagccagtgaaacagatcatcgtgctgaagttagtgccagcaaaaagataacagatgctaaacttgctaaagattttcaagcagttttaaaagaatttcaaaaagcacaacgccttgcagctgaaagagagacagcttactctcctgctgttcctcaagctattcattcctcacgtaatgaagctggtgaagtggatgcaagctcaggcagaagtccagaacagcatgcccttcttgtccaatctaaaagacaggaagtgttgttattggacaatgagattgcattcaatgaggctataattgaggaaagagatcagggaatacaagaaattcagaaccaaattggtgaggtgaatgaaatatttaaagatcttgctgttttggttcatgaacaaggaactatgatcgatgatattgggtcaaacatcgagaactctcatgctgcaactttacagggaaaatcccatcttgctaaagcatcaaagactcaaagatcaaactcttctatgacttgcttgcttatggtgatcttagggattgtgct

SEQ ID NO: 596 - DNA, 851 bp, Lactuca sativa
gcgggggaaaaattacgacatcgtcggccggtaaaagatgagcaagaatggagctggaaggtctgcacttcagcagaagttccaatctggagcacttgtgctggtgtttctctctatctgtactctttccttctcagaggtcatcttcgaggagcgattcgatgatgggtggcagagccgatgggtgaaatctgattggaaaaaaagtgaaggaaaagctggatcatttaagcacacagctggatcatggtctggtgatccagatgataaaggcattcagacatcagttgatgccagacatactgccatctctgcaaaaatcccagaattcaacaacaaaaatagaacactggtgttacaatactctataaaatttgaacaagacattgaatgtggtggtggttatatcaagcttatgtctggatatgttaaccaaaagaaattcggtggtgacaccccttacagtgtaatgtttggaccagatttatgtggcacacagacaaagaagcttcatgttattgtttcctaccaagggcaaaattatccaatcaagaaggatttacaatgcgaaacagacaagttaacacatttttacacttttgtccttagacctgatgcaagttatagtattttaatagatggtagggaaagagattctggaagcatgtatacagattgggatatccttccccctcgtaaaatcaaagatctcaaggctaaaaagcctttggattgggaagaaagggaatatattgaggatccagatcaagtaaagccagagggttatgattcaattccaagagaaattcctgatyctaaagctaaaaagcctgatacttgggatgaagatg

SEQ ID NO: 597 - DNA, 2267 bp, Lactuca sativa
agcaatacagcattggccattggtcacgcgcaccacacaggatcacgtgctctcacaagatctcgagactatcgtcaacgtgatctctctcgaaccatcctgacccttcgtcgcttcttcttcacaaaccctttcgaactctctggaatccctaactttctccatactttcacttacccgscttcttcatataaaatccattcgaacttaattctacttgttgatctgaacccaactatttatctcttcaatttgcttgttttagaaggaaaaatttgtgcttgatcttttttgagtgaaaatggatgaggactttgatattccggtagctgatgagatgaatgatgaatttatggatgatattgaagctccggtgacgttgaaagtcggagaggagaaggaaatcggtaatcaaggtttgaagaagaagctgctcaaggaaggtgaaggttgggacacacctgaaagtggggatgaagttgaagttcattatactggaacgttgctcgacgggactcagtttgattcaagtcgtgataggggaacgccattcaagttcactcttggtcaagggcaagtgatcaagggatgggatctgggtatcaagaccatgaagaagggtgaaaatgcacttttcacaatacctgctgatctggcttatggtgaagctggttctcctccaacaatccctcccagtgctactctacagtttgatgtacaactgctctcatgggttagtgtaaaggatatttgcaaggatggtgggattttcaaaaagattgtaaaggaaggagagaagtgggagaaccccaaggacctcgatgaagttttagtcaattacgaagtccaactcgaggatgggactgtagttgcaaaatcagatggagtggagttcaaagtagaagatggccatttctgccctgctctggctaaggctgtaaaaacaatgaagaaaggggaaaaagtcatacttacagtcaaaccagaatatggatttggagaaaaagggaaacctgaaggctccattcctgcaaatgctacactacaaatcacactagaacttctgtcatggaaggtggtcacaaatgttacagatgacaagaaagtcatcaagaaaatcttgaaagaaggagaggggtatgaacgcccgaatgaaggagctgttgttcaggtgaagttgattggtaagctacaagatggtacattgttcatcaagaaaggtcatgatgattctgagccttttgagttcaaggcagatgaagagcaagtgattgatggacttgataaagctgtgatgacaatgaagaaaggagaagtagctcttctgacaattgctccagaatatgcttttgggtctactgattcaaagcaagaattagcagtggttccccctaattccactgtcacatatgaaattgagcttgtttcttttgttaaggacaaagaatcatgggacatgaccacgactcaagagaagattgaggctgctgggaaaaagaaggaagaaggaaatgcgttctttaaagctggtaaatatttgaaagcagtaaaacgatatgaaaaggctgctaagtttatcgagtatgatactaattttgaagaagatgagaagaaacaagcaaaagcattgaagattacttgcaatcttaataatgcagcatgccagttgaaactcaaggattacaaacaggctgaaaagctttgcactaaggttttggaacttgaaagtacaaatgtaaaggctttgtacagaagggctcaagcttacatcaatgtagctgatctggatcttgcagagattgatgtaaaaaaagcccttgaaatcgaccctaataacaaggatgtgaaacatgaatataaattgctcaaggagaagataaaggaatacaataagaaggatgctaaattttatggaaatatgtttgccaagatgacaaaaccctcttccaataaggcagcagggacaaaggaggcagaagaaccaatgagcgtagacagcaaggcttaatcatttaaaagataaaagataaaagataaaagatgtgtttaatgtaatgttgtgccataatataggggttttctggtattttttttcttaattttctagkgctcttatttggttttaattcttcagatagtgtgtgyttgtctggaaaaaaaaaggtaaaagttagtgtgacgacagttgagttttatttactttctttttatcttcacatttatgtagaaactgtattggcatagcataatctattacaactttaaac

SEQ ID NO: 598 - DNA, 1746 bp, Lactuca sativa
gcaggcgattaggagcttgcaatcagtccttatcatggtctgattctaaagcagaaagttcggtcgatttacgaaaacctagaagcggttatcgtaccaaattaggatttttatagtgttttacagcaactataactctcttttgtcgggcatatataagatattagataagagcatcgattcaattcaagccctctagttttgagttttatattcgcaggtggtggcactgtttacgataattycawccmttatcaaaagcattrcattgatctcttgckyagagtgaaagatttgggagaagtctgaaggctagcttccaacaagcttttctacttgagcaagttggatagaaatcgccaccaaccttctccgattcctgctcaattggatacttaggtatcggaacagaatgcatcgattattgtcagagattttaatggatacccaagggggaggagaatcgctgttaggatccatcaagatcgcggttctacccatagccaaagttttcacgatgtgcttcttggggtttcttatggcttccaagtatgttaacattttgcctgcaagcggaaggaagctcttgaatgggttggtgttctcacttctgctaccatgtttgatattctctcaactcggacaagccatcacctttgaaaaaatgatcgaatggtggtttattccttttaatgtgattttggctacaatatctggttcacttatmggattacttgtagcatgcattgttcgtccaccatacccatacttcaaatttaccattattcacattggcataggaaatatcgggaatgtgccacttgttctaattgcagctttatgtcgtgataaatcgaacccttttggagattctgctacatgcactcgtgatggaaatgcctacatctcctttggacaatgggtgggtgcaattgttctatacacatatgtatttcaaatgcttgcaccmcctcctggaggttcttttgagattgaagatactaaaaatcttcctattaaaaatcctccaaaaactaacacmaacaccaataatccccctgaagaagttcctcttctcactcatgagcctgaatccatagatcaagatactcctaaagatggaaagataaaacaattcatgaagtttctgtatgacaagttgaagctgaagcaaatactccaacctcctatcattgcatctatactggctatattcattgggtgtataccatttttaaaagggttgatcttcacacctgatgcaccactttacttcttcactgacagctgcttgattcttggggatgctatgattccttgcattttgttagcattaggtggcaatctgacagatggacccgggagttcaaaattagggttaaaaacaacagctgcgattatatttgggagattagttttagttccaccagctggattggggattgtgacattggctgataaacttggattgcttccacctgatgacaaaatgttcagattcatccttcttttacagcattccatgcccacatctgttttatcaggtgctgttgcgagtttaagagggtgtgggagggaagctgcagctattttgttttgggttcatatatttgccattatttcaatggcaggttggattgttttgtatctcaacatccttttctagaacactctattttctgaaacttgaagaagaagaaaacagctggatgtttggtatgaaactatgaatgatttcaaggatca

SEQ ID NO: 599 - DNA, 1088 bp, Lactuca sativa
aaaaaggagaattttctttaatattctctctctctctctctctctctctctctctctctctctctctctgatcaagaacaatgggtttaccggtgactgatccgatgactcaattaagtttaccaccagggtttcggtttttccctaccgacgaggagctgctagtgcaatacctttgccggaaagttgccggacatgatttctctcttcagatcattgcagatattgatttatacaagtttgatccatgggagcttccaagtaaggcgatgtttggggagaaagaatggtacttttttagtccaagagatcgaaagtatccaaatgggtctcgacccaatagagtagccgggtcgggttactggaaggctaccggaactgataaagtgatcaccaccggtggacggagagttgggatcaagaaagctttggtgttttacgtgggtaaagctccgaaaggaaacaaaactaactggatcatgcatgagtataggctgtcggagccacaaagaaaaaacggtagctcaagggtgagtccgatcaatctctgatcattctgttttttgttaataaaaatctctgtttcattytctagattcttaatctgggttttgattttggttcaacagttggatgattgggtgctttgtcggatatacaagaagaattcaagtgcacagaaacacatttccggtggcgctccgaccaccgaacagagccacggttcttcttcatcttcctcctctcagttcgacgacgttctcgaatcactgccggagattgaagacaggttcttcaacttaccaaggatcaactccttgaagacctttcaacaagaagatcagaaggtaaatcttcaaaaatttgattctggtaattacgattgggccagcatcgctgcgttcgggttgccggaacctgccactggaagtcaagctccgaccaccgccaacaccgcaatgaatgtcattccttcaatggcgccggcgaccacatacacaatggacgcaacatttggaagatcagtagaggatgaagttcaaagtggaatcagaagccaacgggtcgaacatccgggttcgggctac

SEQ ID NO: 600 - DNA, 993 bp, Lactuca sativa
tcattgcttttgcggcaatcacccccaaattgcgctaaataattcttcatcaaccctcacgtcacgccgattgccaaacccgctcacaatctttaccctttcgatcgagaccaccctgctcgatcgttagggtttttcatcttaatcgaattattctttgtcgtaggattcgcatcaaatctcaaagtttagggtttattcgagggatacatcagggataagataagatgagctttcaagatcttgaagccggtcgccaattcaattcaagaggagggggatacgcaaacggcgtcaggaaacaagatccgacccaagctattgcttccggtatttttcagatcaacaccgccgtctcctcgtttcagcggctagtcaatacccttggtactcctaaagatacccacgaacttcgagaaaaactgcacaaaacaagactacatattggacaattggtgaaggatacttcagagaaactcaaaaaagctagtgaaacagatcatcgtgctgaagttagtactagcaaaaagattacagatgctaaacttgcaaaagattttcaagcagttctaaaagaatttcaaaaagctcaacgccttgcagctgaaagagagacagcttactctccttttgttcctcaagctgttcttccttcaagttatgcagccagtgaaatcgatataagctcagacaaacacccagaacaacgtgcccttcttgtggaatctagaagacaggaggtattgttattagacaatgagattgcatttaatgaggcgattattgaggaaagagaacaggggattcamgaaatacagaatcaaattggggaagtgaatgagatttttaaagaccttgctgttttagttcatgaacaaggagccatgattgatgacatcgggtcaaatattgagaattctcatgcttcaactgcacmagcacgaatccagctttcaaagcatcaaactcaaaagcaaatcttcatgacttgct

SEQ ID NO: 601 - DNA, 1559 bp, Lactuca sativa
  misc_feature (1475)..(1475): n is a, c, g, or t
gttggacccgggattcggactgatggcctckswrcggggakctcaaattcatcaatcatcagtaatcacgacctcttgtctatgtcgtggcaaattgttgttcaagcccttagattttgaagcagattaatattaatttcttgaagaacaagtaaaacccctactggaaatcaagtttagtacattggttcagctctagaaggtattctaatcatgtcgaggaagatgctgattgacggagatttggataatctttctggagagaatgattacgattttgatctgttcgtgattggtgctggcagtggcggggttagggcatccagattttcagctcagtatggagctaaggttgggatttgtgagctaccatttcatccagtcagctcagaaaccatagggggcgttggaggaacgtgtgtgattcgtgggtgtgttcctaaaaagatcttggtctatggagcatcctttggtcctgaaattcaggatgcaaaagaatatggatggaaagtgaacgataacattgatttcgattggaaaaagctacttcacaagaagactgaagaaatagtgaggctaaatgggatatacaagcgcctactttcaaatgcaggagtcaaactttttgaaggagagggtagaattgtgggccccaatgaagttgaagtgatccaattggatggaactaaactctcctattcagcaaaacacatactcatagcaactggcagcagggcacaacgtccaaatatccctggacaggagctggctataacctcagatgaggctttgagcttggaagagctaccaaagcgtgtagttatacttggaggagggtatattgctgttgagtttgcttcaatttggcgtgggatggggtccactgtgaatctaatcttcagaaaggaacttcctttaaggggttttgatgatgaaatgagagctcttgttgccagaaatcttgaaggaagaggcataattttgcatccacaaacaaatataacacagttggtgaaaaccgaagatggtataaaagttaccacagatcatggtgaagaattaatggcagatgttgtactttttgccactggacgtgtacctaataccaagaggttaaatttgcaaagtgtaggggttgaagttgacaaaacaggagcagtgaaggtggatgaaytttctcgcaccaatgtccctagcatttgggccataggtgatgtcacaaatcgaatgaatctcactcctgttgccctaatggaaggaactttatttgctaaaaccgtatttggtaacgaacctagcaagccagactacagcaacataccttgtgccgttttctgcatwccacctctctctgttgtgggactaagtgaagaacaggctatagarmaagstgaaggagacattttgrtkttcacatcaacatttaatccyatgaagaactccatttctgggaggcaagagaaracactcatganacttattgtcagtgctgagacagataaagttattggtgcctccatgtgtgggcccgatgcagcagaaattatgcagggtattgc

SEQ ID NO: 602 - DNA, 615 bp, Lotus japonicus
aagaaagtaacgaaaccaaatcttctttcctttccttctcttcacgccctaattcccaaatccgatcccggtaaacgccaccaccaccttcgattccttccctttctcaggaaaattcccctgattttctcgggaaagttagggtaaatccgccgaattacaacagaattatgagcttccaggacatcgaagctggccgccctttcgggtcgaggtgtggaccgatcaacgggaagcaggaccctacgcaagcggtggcggccggaattttccagatcaacaccgccgtgtccacgtttcagagactcgtcaacaccctcggaacccctaaagatacccctgagctccgtgagaagcttcacaagacaagactacatattgggcaattggtgaaggatacatcagctaaacttaagcaagctagtgacatcgatcaccatgttgaagttaatgcaagcaagaagatagcagatgctaaacttgcgaaagattttcaggcagtgctgaaagagtttcagaaggcacagcgtcttgcagctgagagggaaacggcctataccccttttgttccacaagctgttcttccttcgagctatacagctagcgaagtagata

SEQ ID NO: 603 - DNA, 678 bp, Lotus japonicus
ccggtctactggaaataaccgcattgttttccgtgtacagagaaaaaaacgaaacaagagaaatctataacaacagcaaaacaaaaacgctcctcttttgaactcttcttaattcttatccttcaattcttcctcatcatcgtgaaatctcagcagaatgggagttccagaaaaagaccctcttgctcaattgagcttacctcctggtttcagattcttccccactgatgaggagcttctggttcagtatctctgccgtaaggttgctggctatcatttttctctgccaatcattgctgaaattgacctgtacaagttcgacccttgggttctaccaggcaaggcgattttcggtgagaaagagtggtattttttcagccccagggacaggaagtacccaaacggttctcgacctaacagagttgctggctctgggtattggaaagccaccggaactgacaaagtcattaccactgaaggtagaaaagttggaataaaaaaagcactcgttttctacattggcaaagcaccaaaaggcaccaaaactaactggatcatgcacgagtatcgccttctcgactcttcgcggaaacacaaacttggcagctccaggctagatgagtgggttttgtgtcgcatatacaagaagaaatcgagcacgcagaaggaagcggcagc

SEQ ID NO: 604 - DNA, 979 bp, Zea mays
gaccgcgtcgcctctctcctcctttcgcgtcgtctccctcctccactctcctctcctctcgcgtccgcagcttcccttgccggctagggtttgcagatgacgacggcggcgcgccccacctgggcgccggccaagggcggcaacgagcaagggggcacccgcatcttcggcccctcccagaagtactcgtcccgcgacctcgccgcgcatacctcgctcaagctcagaaaagacggtcaacagacccaagaggagttacagaagaggaatctcagggaggaacttgaggaacgtgagcgcaagcactactcttccaaggataagtcctatgctgaaagagaccggcggaaaagctcaagccagctactcctagaaggttcaaagagagaggcagaggataagatagttccacgagaaatcgatgcagatgactccgatgtggagcctaaaagtgatgatgagagcgatgaagatggcgacgacgacgacaccgaagctctaatggcagagcttgagaggattaagaaagagagagcagaggagaagcttagaaaggagcggcaacaagcagaggaggaggccaagatgaaggaggctgaactgatgcggggaaaccctttgattaatatcaacaatcctggctccttcagtgtcaagagaaggtgggacgacgacgtggtgttcaagaatcaagcacgtggagagaccaagacgccgaaacggttcatcaacgacaccatcaggagtgacttccaccgtaaatttcttcatagatacatgaagtaatggtattgtcgtgtacaattcagatgtctccgtgctgtttatgtcagtgcattggttctctctcatcgttgttatgtttcgtgtatgagtgaacggccattgttgtgttgtatatgaaacaaaacatctgtcagcatcttaacaatgcctacctcatggtgtccaagttgatctgatttcactcacttttgtc

SEQ ID NO: 605 - DNA, 3011 bp, Zea mays
gcttctggttgattctggtgatcacaatgtggtgaatgacattttccgacgtatttctatgggtgaaagttggactgggaagtttccagttaagagcaaacaaggagatagattttcagctgttgccaccaacacacctttctatgatgaagatggaagtttggtgggtatcatttgtgtttcaagtgattcccgccacttggagcagatattttgtaagcctccaacctctgcaaggcctcaatcagaatcatctaggacatcttgtgatgggagttgcagcaacactagtcgcagaatcaatttgttgaacagaagtccttttgatcctcagatacccctgcaaagcacttttgcatccaggataacgaatttggctaccaaggtcacaaataaagttcgttctcgggtcagcacagacgattatggcatagaacgggaaggtggcagtggtgagagtcattgttcggatcgtggtgcaaaggaagaaccaacatctagcggaacaaatacacctagagggaatgcaccacatggtcccttttctacagatgagaactcccctgggaaatcaacgaacccaagcagtgatgaattagaaggaaaagtaggtctgcacaagtttttgagttcaaaggcagaggcactactgaacaagaaagggatatcatggccttggaaagtgcgcgagaatgacggacctgatgaaagaaatcatgtgatattgttgcatggagaccaagagaatgttatgaatcatcagaaggtttcagattctagcatagctccagattcccaaggcgctgaacacaacctacctagcaaaaatgaggcatcaggttcctggtcctcttacaacaataacagcacaagcagtgcaagcagcacaggaagcactaatagcagtgctctctacaaagtagatcatgaagcggattgtctggattatgagatcttatgggaagaccttgtcattggagaacaaatagggcaaggctcttgtgggacagtatatcatgctttgtggtatggttcggatgtggctgttaaagttttctccaggcaagaatattcagaagatgtgatactgtcctttcgacaagaggtgtcccttatgaaaaaactgcgccatcctaacatactgctcttcatgggtgcggttacgtctccacaacgcctttgtattgtaacagagtttctccctcggtatgtgcctacttttttttatgggcatacatgtttgcaagtgtttcttattctgtagcattatctcactgagtcactgttgcacatctacatgagttgagccaagaagtatgtttatatctggttgaattgttcgactgcaacagcaatagttgcataaggaaaaggaaatttaaattcagaaaatctaggcttggtttaagttgagaagtcattgatatgcatacattttgctgttggaagtattgtatcctgtaaaataaaatctgtatttaagtaggattatgtagtaactagtaaaaatgtttctctcgaaattgaagtattctgtccaaccttagtgaatcttgatgcatgtatagaatataaaaccataatgtatagcctaggtgatactttccctggttcaaacttcaagatatatgccgtttaaattcctacagatcaaacatttttttgactttgaccatggatatgtaaaggattgcgtagattgactatgtaagatgttgctagatttatcatgaaaattactttcacaatatttaattatgtttattgaagatcatatttttcgtagaaattgctagtcaaagtgtcaccttgtaggctatgacaatgcctgaagtaccattatatattttgattctgagggagtattctccatgggtgatggatgacagcagatctatgatatccttttccttgggttgggttggttccatgttcaaaacactgtcaagcactcaaacacttctctctttttggttcatttccgtattttttcacttctgtcttttcaaatgcagtggaagcttgtttcgcttacttcaaaggagtgctaccaagttgggtgtgagacgacatgttcacatggctttagatattgcaaggggcatgaactatcttcaccattccagcccacctatcattcaccgagatttgaagtcatctaatctgttagtcgacaagaactggactgtgaaggtggcggactttggcctttcacgtctcaagcgcgaaactttcttgacaacaaaaacgggaaaaggaacaccgcaatggatggcgccagaggtgctgcgcaacgaaccttccgatgaaaagtctgatgtgtatagctatggggtgatcctatgggagctcgttactcagaagataccctgggaaaacctgaactcgatgcaggtcattggcgcagtaggttttatgaaccaaaggttggatatcccaagcgaagtagatcctcagtggagatcaattatcctgaactgttgggaaagcgacccgcagcaacggccgtcgttccaggagcttctggagaggctccgcgagctgcagaggcgttacgccatccagcagcggaacgcgaagaacagcgtcgaggagtgaagactgaagaatgcaatgcaactctcccaagcggcggcgggcttgctttgaagcattttgcgagccagcagcatgccagatctagagaagggcctgagcctcctgtactggggcctgggggctgctaaggctggaagaagtatgttctacagacgaggcgccttctgtcttcttctttttttttaaaaaaaaagaaagttcttccccatggcaattgtgactgtaattaatttctgggtcctgacagcaagggtcagtagggtagcgagtgagtagtgactgagctcgggcttgcttgctagcgcctctgggttctgattcttgacaacgcaaatgcgtactacgtggttaacagtaacatccaatccagcctccagtttctggcaagggcatgcatgatgatgtgtagattg

SEQ ID NO: 606 - DNA, 1539 bp, Zea mays
ttcggcacgagctttggttgctgtggtttcgtgatggcggcggcggcgatctgcgtggaggacgaggcggcgtgcgccgccgcggaatgcgcggggatcgggaatctggatctcgctgccgccggcgccggggctggcggcaagaggagcgtctatctcatggactgcgcgccggtctggggctgcgcgtccacgcgcggccgcagcaccgagatggaggacgcctgcgccgcggccccgcgcttcgcggacgtgccggtgcgcctgctcgccagccgccgggacctcgaccgtctgggcctcgacgctgacacgctccgcctgccggcgcacctgttcggcgtcttcgacggccacggcggcgccgaggtggccagctactgccgggagaggctccaggtgctcctgaggcaggaactgaggctgctcagcaaggatttgggggagacaagcgaggccgacatgaaggagcactgggacgagctgttcaccaggtgtttccagaggctggatgacgaagtgtcggggcaggcgagcaggctcgtcggtggcgtccaggagacacggccggtggccgccgagaacgtcggctccactgcggttgtcgccgtcgtgtgctcctcccatgtggtggtcgccaactgcggggattcgcgtgttgttctctgccgtggaaaggagcccttagagctgtcgattgatcatcaccctgacaggaaggatgaacgagcgaggattgaggccctggggggaaaggtcatccaatggaatggctaccgggtctccggtatacttgctatgtcaagatcgattggggaccggtatctgaagccgttcgtgattccaaaaccagaggtcacggtcgttcccagggcgaaagatgacgactgtctcatcctcgcaagcgatgggctgtgggatgtggtgacgaacgaagaggcatgcaaagctgcgcgccggcaaatccaagtgtggcacaagaacaacggtgccgctggcgcattgtggtcgttgtgcgacgagggtgatggatccaccaccgaccccgatgcccaagccgcagcggattatctcgtgagggtcgcgctgaagaagggtaccgaggacaacgtccccgtcatcgtggttgacctgaaccctcgaaagaaaagctcaggagcaactcgtagcatcgggcgttctgggtccatcacagtagagctgagctgaccatggcatggccaaagaactgctgctaggtgctagctggtcgtccgcacgagacttgaccggcccacagttttttttttgggtccgttgggcgtcaagaattgtacatgtatatatggtagatgcgttttccgtggagggttatggcgctcaaccccgctcttgtttttgttggctaaaaatctctccaatcggcatctctaccgtgagccccccctggcacttagtatgcccctaatgctgtatgatagtcgagctagtaaagagccaagcggctgagacgatcactaaaattaaggggctgtacccttcatgattctaaaaaaaaaa

SEQ ID NO: 607 - DNA, 1154 bp, Zea mays
cacacccagacacctcctacttatcttgcgcgccaagggccagcgcgcgagcgacctcacttgatccgctcccttcgccgcgacgacgttcctacgcagctgcggtcgacgcgcgcacggcagctcgctcgctagctgatcacgacagctcgctcggctcgaccgaatggcgccgcggctgctggcgtgcttcgggcgcggcgtcgcggcggcgccggacgacgcgactggcgagggccagctggaggcgccccccgctggcccggtgctggtggagctgttcgggtcgcaggggtgcggggcgtcgcccgaggcggacgccgtggcggcgcggctggcgcaggactccgggtccggggacggcgccgtcgtggtgctggcgttccacgtcgactactgggactaccgcgggtggaaggaccccttcgcgtccagcgcctggaccgtgcgccagaaggcctacgtggaggcgctccgcctcgacacgctcttcacgccgcaggtcgtcctgcagggccgcgcgcactgcgtcggcaccgaccaggacgcgctcgcgctggccgtccgcgacgccccgcgctaccccgcgcccgccatcaaggtcacgttccagcggccgagccccgcaacactgcaggcgtcgttcacgggcaccctgcgcagccgcgtggagggcccaggcggcgcgagcgtgctggtggcgctgtacgagagcgggctggtgaccgactgcgggcgcggcgagaacaagggcaagtcgctgctcaacgaccacgtggtgcgccgtctcgagaaggtggccgccgtgcgggagggcgcctcgccgaagaagaccgtgtcgggcaccgtccagttcccgctctgggacggctttcgcgccaccaagtgcggcctcgtgctcttcgtccagaacgccgcgctgcaggtgctcggcgtccagcacttcgacctgcctgacaacgtctgagctcgtgacgcggtggggcgcgcgcgcgttccgcgttggctgcctccctgcggcgggcgtcacattctttgtatcactgtatgtagtacatcactggatggtatttagatggaaaacctgagtattctttatctccacgtatgttcttgttctgcattatggcaatggatcttctgttttgcacact

SEQ ID NO: 608 - DNA, 579 bp, Zea mays
ttttgatttggcttttgtttttggcacgagccccagcccaactccgatcgcacgagccccagcccccaaacagcctccaggtctagctagggtttcgtctccgccgcttgctctaatcctctcccggcacgcgacacgcgagggcgcagcgtttatggcggcgacaccggcggacgcgaagaccgaggccgccaagatggacctcctcgaggacgacgacgagttcgaagagttcgagatcgaccaagaatgggatgagaaggaagaaggcaatgaagctgtccagcagtgggaggatgattgggatgacgatgatgtgaatgatgatttctcgctgcagctgaggaaagaactggagggaagcaacgcccagaagagctgaagtattatttctccagtttacaaatgatccttctatgccagctacttctggaaatcggaacctttatgtgatttgtgctgctgggagcaatcgaactctggagtaagaaagtaaccataccagtgatttctaagtatgaacggcaggaagttgacggacatcagtcggctatttaaaaaatatctcagttgtggtta

SEQ ID NO: 609 - DNA, 1070 bp, Zea mays
ccgttgggctcggctcgcgcggcgccgtcctctcccactctctacgcacgaacacagcacgcgccgcaccccgctctctctctcctgcgttcccatctgcggcggggagtgagcacattgaggacggtctactcctcgttcgcgtgcggttcgtcccgagcgatccggcaaccatgaacatcttcaagaagaaggtcgaccccaaagaggctctcaggaccagcaaacgtgaaatggcggtcgccacgcggggagttgagagagagattggttccctgcaaatggaggagaaaaagctggttgcagagataaagaagactgccaagactggaaatgaggctgcaaccaaaatattagctcggcaacttgtcaggctgaggcaacaaatcctcaatttgcaaggcacacgggcacagattcgtggagtagctactcacacacaggcaatgtatgctggcacttcaatctctgctggaatgaaaggtgcaagcaaagctatgtcagcaatgaacaagcaaatggaaccggcgaaacagataaaggtcatgaaagaattccagaaacaatcaacacagttggacatgacgcttgagatgatgtctgatgctattgatgaaacacttgacaaagatgaggcggaggaggaaacagaagagcttacaaaccaggtccttgacgagattggcgtcgatgtggcttctcagctctcttcggctcctaaagggcgcatcggagctactaacaagaaagtcgataatggtcaagcacgtcctgcaaggaacgtggcggctcctgctctagaaccctcctctgctgaagttgaggatctggagaggcgactggcatctctgcgccgtacctgagtctgagctgttgaagaaagaacttgtttgtaatactagcagttattcatctatatatgtaaagttggtttatatgtgtagggaaaacagcgagctgcacatgatacggttgaacctacttaatgttttatttaatttggaagttgactgcacagtgaccctagtcgctagtcccataagccgacggaactaggcgaagccagggct

SEQ ID NO: 610 - DNA, 688 bp, Zea mays
gtcctgcagggccgcgcgcactgggtcggcaccgaccaggacgcgctcgcgctggccgtccgcgacgccccgcgctaccccgcgcccgccatcaaggtcacgttccagcggccgagccccgcaacactgcaggsgtcgttcacgggcaccctgcgcagccgcgtggagggcccaggcggcgcgagcgtgctggtggcgctgtacgagagcgggctggtgaccgactgcgggcgcggcgagaacaagggcaagtcgctgttcaacgaccacgtggtgcgccgtctcgagaaggtggccgccgtgcgggagggcgcctcgccgaagaagaccgtgtcgggccccgtccagttcccgctttgggacggctttcgcgcccccaagtgcggcctcgtgttttttgtccagaacgccgcgctgcaggtgctsggcgtccagcacttcgacctgcctgacaacgtttgagctcgtgacgcggtggggcgcgcgcgcgttccgcgttggctgcctccctgcggcgggggtcccattttttgtatcactgtatgtagtacatccctggatggtatttagatggaaaacctgagtattctttatctccacgtatgttcttgttttgcattatggcaatggatyttttgttttgccccctaaacttattgtgtggtaaaggggccgggggtttgggggg

SEQ ID NO: 611 - DNA, 1185 bp, Zea mays
ccctcccttgccgtccacttcttcctccaccacagtcatcagtggcgttatcctcttcgttctcgcctccctggttgttgttggctgggtgttggcgagctgggagtagagaccgagaagtggagcggccatgaagatccagtgcgacgcgtgcgagggcgcggctgccacggtggtgtgctgcgccgacgaggccgcgctgtgcgcgcgctgcgacgtcgagatccacgccgccaacaagctcgcgagcaagcaccagcgcctcccgctcgaggcgctctccgccaagctcccgcgctgcgacgtctgccaggagaaagcggcgttcatcttctgcgtggaggaccgggcgctcttctgccaggactgcgacgagcccatccacgtcccgggcacgctctccgggaaccaccagcgctacctggccaccggcatccgcgtcggcctcgcctcggcttccgcctgcagcgacgcctgcgacgcccacgactccgaccaccacgccccgcccaaggccaccatcgagccaccgcacgccgccgtctccgccgcggtgcagcaggtgccctcgccgccgcagttcctgccgcagggctgggccgtcgacgagctcctgcagttctccgactacgagtccagcgacaaggcaagacgatagcgcaagctccggtccatgtccgcgtgcacccaccggatcccgtctcacgttcttgctctgttttatgtgttttgcagctgcacaaggagccgacgctcgggttcaaggagctggagtggttcgccgacatcgacctcttccacgagcaggcgcccaaagccagcaggacgttggcggaggtgccggagcttttcggataccaggcggcgaacgacgcggcgtactacaggccggccaaagccgccgccggcggcggcgctggggttcgccagagcaagaaggcccggatcgaggtcaccgacgacgaggattacctcatagtccctgatcttggttaaataagagagcgcaggagttttgtttcgtctcctgatgtgtacggtgtaccagagaagaattttactgtgtacaagctagtgtcaagtgttgtgcatctttgactgtagtgtcgctcaattctgaacatctattaagccacttttgttgctatgctaataccagtctgagagacactgatgtttttaaca

SEQ ID NO: 612 - DNA, 1101 bp, Zea mays
actactgccgggagaggctccaggtactcttgaggcaggagctgaggctactcggcgaggatttggggcagattagctgcgacgtggacatgaaggagcactgggacgagctgttcaccggatgcttccagaggctggatgacgaggtgtcagggcaggcgagcaggctcgtcggtgccgtccaggagtcacggccggtggccgccgagaacgtgggctccactgcggttgtcgccgtcgtgtgctcatcccatgtggtggtcgccaactgcggggattcgcgtgccgttctctgccgtgggaaggagccagtagagctgtcgattgatcacaagcctgacaggaaggatgagcgcgcgaggattgaggccctgggaggcaaggtcatccaatggaacggctatagggtctccggtatacttgctatgtcaagatcgattggggaccgatatttgaaaccattcgtcattccaaaaccagaagtcaccgttgttcctagggcgaaagatgacgactgcctcattcttgcaagtgatgggctgtgggatgtagtgtcgaatgaagaggcatgcaaagctgcgcgtcggcagatccagctgtggcacaagaacaacggtgtcacatcatcattgtgtgacgagggtgatgaatccaatgatcctgctgcacaagctgctgctgattatcttatgaggctcgcactgaagaagggtaccgaggacaatatcactgtcattgtggttgacttgaaacctcgaaagaaggccaagagcaactcataacactgggatggatccatcacggtagagctgaccatgatatgtccaaaggcttctgctgctagttgttggtcgtccgcaagagacttgaccccacaggtttttttcgttgggcctcaagaactgtaggtgcattttccatggagggttatgatgcttaaccccactctggtttctgatggctaaaacattctctccagtcggcttctaccatgagccctggcacttagtatatccctaatgttgtatgatagttgaacttgtaaagagacaagcggctgagacggtcactaaaattaacatattgttacttcatgattca

SEQ ID NO: 613 - DNA, 2652 bp, Zea mays
cggggggcatcgggccaaaccaaaagcacggacaccaaccaaaggccaactcatgaacaccaacaactagtgtagtgtgtagttgtgtgcacgctggcttggtccccgtagcagagaaccccacccccataaaagctcctctccattggccgaacgccgagagcaccactccctccctccggctcccaaccccagcacagcgcagcagcagtcctctctcctctcactctactcctccagctccccacccctctcccaaaacctcagttcaatcccaggtttcaaatccgccaccttttggacacacaccacacttgcctacccccagagctgagctagctagctgctctctctctctcttttcacctaagcgagaacagagcccaagaggcctcaaaagaaccactgcacttcctccgcatagctcgtcgccctctctctcctatcagtcctcccagctccagctaccacagcagccctctcgcttaaaggaggagggagaagagggcggggcgagcaatgtcggagcagcagcagccattgccgcagcctcggagcagcatgcgggaggctctggagaaggaggacaaggagaaggcggcggctgctgcggcggccaaggagaaggcggccgtccccaagaacggcaacggcaacggcggcaagaatggcggcggcgccggcagcggcaacggcggagcgcccccgcagtccggggaggagacggcccgcgagatccaggtggtcagggaggcgtaccgccgcgagacggccgcgccggcctacgtcatacccgaggagccgccggccgtggtcgagctcgtcggctggtacatctacggcttctgctcctacttcatcacccacctgctgctgccggtcctcttcccggccatcatcacgcaggtcgccttccccaactccgacttcacgcccgaccccaagtacaccctcaagggcgtcacctgctccgtccacgagatgtccatgtaccagaggcttaccaagcactccattgtgatcgatggatcccggatgtcaccattgggctggagtggactgtcgtgggcaatcggcatcctcatcgtggcgccgctcctcacccagaccgctcaccatctcgaccgtggccagtaccagtcgctgatcctcattgccgccacgtccttcgggtccttcttctgcctgctaacaggcttcttcaagacggtctgggtgttcctgttctacatcctcttcatcgctggctcgatcatcgtcgctgaggcggtgcacacccgcaaccttgggctgatgatccgtggcctggctgcgcatgactcgggcaagcaccttgtccttcgccgccgcgctgctgccagccagctcagcctgtactgcactgccataggaggcattggagctgccctcatggcagctttcatgtaccacatgctgcggcgcactgaccagctcactggcctctgggtcgtgtccatcttctgtggccttatctggttcatcggcatctgccatggcctcttcacaaacaggcccagcagctcgtcacccaccaccgcattcgagcccaacttcttcaccaagctcagctacagcatgaccctcctccgttacccgcaggccattggcagcctggttgcggtgttcctgtcctctttcgccacaatgtgcatcttcaccagcggcacgctctatgctatcggtggtgtctgcatcaagccggtgctcgtgcttgcgctatggatcctctactttctgttccccttgatctcgctcccgctcctccacccgatccagatcataatccgcgcggacgccgtgcgcatgcagctgctcgggttcataatctgcctgttcgtgtccggtgccgggttctacttcaagagccacaggtggagggctgcccacatcatcgtcatcgccctggtccagagcaccgccaatggcatactgtacgcgttcggccgcatcctgctcctcgatgcctcgccgccggggaaggagggtgcgttctcggtctggtacgcgtttgttcgtgtcaccggtgccatgatcggcttcgctgcctcctccgctggccctgggcgcgcgggagggtcctttgctgctgcgttcctcgggagcttcctgggcatcatcgtgctgatcttcggcaacgtcagcaacatcggggcgctgaaggcggccgggcacctcaaggggatggacgacgagaagaggatgggcggtctcgggatggagaagggcgagggcatgggtagcgccgtcgctgattctggcgagagcagggggagggtatgatgatgactattcgtgacagtgaattcctgggaggtgggggagaaaaggattgcgtcctgtggaggttgtgcttgtgagaaggatttgttctctcttttttttcttgtttctttggccgtgtttcagtgacactgttgatggatcccagtgcttcgcccgtttgatgcatcatggtggtggtggtgatgatggatgacatagtggtaggggagtgtgtgctagttgttaatgtgttatttattcttttgcttgcaagacaattgtaactgatgatcgttagatcatatggttcttccttcgttcttcacccgcccccaaagtctcttgcagtaaagcttcattcatgattca

SEQ ID NO: 614 - DNA, 1475 bp, Zea mays
ccaacccgcgctgccacttcggcttctctttctatccctccactccctcttatctgctgcgccatcctccccggcctccaccatggccacagccgccgcggccaccgcctcctcctccctcctcgcgccggcggccagcagcacggcgccggcctcgtcaaacgcgctgctgttcccctcctccgtgccgtcgctgcgtgcgtacccgcggctcctcctcgcgttccgccgccccgccgcggccgccatcgccgacccgcagggggccgtgctcgaagaggaggcggaggtcgaccagcagggccagtacgacgacgacgacgggtatgagggcgggcgcggccccgcgttcacggcccccacgcgcccgcgcaccggcaaggccgcgctactgcttaagcgcgaccgcacgaggtcgaagaggttcctcgagatacagaagctgagggagagcaagaaggactacgacgtgcccaccgccatctcgttgatgaagcagatgtccagtgccaagtttgttgagtcagcggaggcgcacttccgcatgaatctcgaccccaagtacaatgaccagcagctccgggccacggtgaatttgcccaagggaacaggccagtcggtgaagattgcggttctcacacaaggtgagaagatagatgaagctagagctgcaggagctgatatcgtaggtggagaagatttgattgaacaaataaaaggaggatttatggagtttgacaaattgattgcatcacctgatatgatgcctaaggttgcgggcttaggtaagattctaggaccaagaggactgatgcctaaccccaaagctggcactgtttcttcaaatattactcaggctatagaagagttcaagaaagggaaggttgaatacagagttgataaatcaggaattgtccatattccctttggcaaggttgactttccagaggaagatctcattgcaaacttcatgtctgttgttcgctctgttgagaggaacaagccatctggtgctaaggggatatactggaaaacggcgtacttgtgctcatccatgggaccttctatcaagctaaacataaaagaaatgcttgactatggtttggagtcatctgactagatgtgaccacaggcaccagttaagtcagctggcatcgttatcaccttcacagattaactatctgccccttgcgacaaatgagcagaaacatggttggtgtatggcaagcaggtgcttaggtacagttttctcagttttacgggcacatcatgagagcagctaaagtcacccaaattgacaaagagatggtttgttggtcatgtatttatgagaaaattatgcacggtttcatagatgtctgtctctgagacgtttgttgtaatgtttcatattttgtcaatagtcatccttgagcttaagccaacaatttgttttcacctgtcattaatttaattacctttcatatttacaaggg

SEQ ID NO: 615 - DNA, 1668 bp, Zea mays
gaggccctgccccatcctgatgagcgtgttgagtatgaattttggaccaacagcaacgatgaatgtggcccgaagtgcgatagccagattgattttgtcaagagcttcaaaggagcagcacaagtacttgagaagaagggctatacagagttcactcctcattacattacctggtattgcccagaggccttcattctgagcaagcagtgcaagtctcagtgcatcaatcatgggagatactgtgcacctgacccggaacaggattttagyaaaggatatgatggtaaagatgtggtggtccagaacttgcgccaagtttgtgtctttaaggttgctaaggagcacaagaagccttggttatggtgggactatgttactgattttgcgattcggtgtccaatgaaggaaaagaagtacacaaaggagtgtgctgatggtgttatcaagtctcttggccttgatcataaagcaatagataaatgtattggtgatccagatgctgatgaagaaaaccctgttctgaaagctgaacaggatgcacagattggcaagggctctcgtggtgatgttaccatcttaccaactctggtaattaacaatagacaatacagaggtaagcttgacaaaggagcagttcttaaagcactttgtgctggttttaaggaaactactgagccagccgtttgcttgagtgaagatatacaaacaaatgagtgcctagagaacaatggtggctgttggcaagataaggctgctaacatcactgcatgcaaggatactttccgtggaagagtttgcgagtgtccaattgtgaaaggagtaaaatttgttggtgatggctatagtcattgtgaagcttccggatctgggcgatgtgaaattaacaatggaggatgctggaaagataccaagaatggtcggacatactctgcctgtaatgatgatggctgcaaatgcccagatggattcaagggtgacggtaggcacaaatgtgaagatattgatgagtgtaaggaaaggactgcgtgtcaatgcaaagaatgcaaatgcaaaaacacatggggaagctatgagtgtggctgcagtggaggcttgctttacatgaaggagcatgatacatgcataagcaaaagtggagcatcagaagcaggctggggcttcttgtgggtcatcttctttggccttgttgcagcaggaattgcaggatatgcagtgtacaagtacaggatccggaggtacatggactcagagatccgtgccatcatggctcagtacatgcccctggacaaccaaggagacgtccagagccattctcatcacattgagatgtgaggacaggaggatgcagacttgacgaggggggaccgggacttgatgtagcctatatatacacttgaattagatgtctataactgtaacgatcttatgtttagcatgcttagtccttgaacaatctgtatccgtgcggtttctgtgttaaggctgacaccgtcttgtttagtaataattgccatcttttctttcggtgccaataaaggagatggcaagacgastgtgttatgtttgtggtcaaaaatttgagcgcccagcgtaacagaaattgtgcctggtgtaaattatttgatccatgatgtgtttgtagatcatttgtgtttgaaccgaatccgt

SEQ ID NO: 616 - DNA, 1507 bp, Zea mays
ggcgccggctacgagggcaaggacgtggtggtggagaacctgcgccagctctgcgtgcaccgcgtcgccaacgaaacgggccgcccctgggcctggtgggactacgtcatggactacaagatccggtgctccatgaaggagaagaagtacaccaagacctgcgccgaggacgtcgtcaccgcgctcggtctggatctcaagaaggtgctggagtgcatgggcgaccccgaggccgacgccgacaacgccgtcctgtccaaggagcaggaagaccagatcggtagcggatcgcgaggcgacgtcaccatcctgccgaccctggtcatcaacaacgtccagtacagagggaaattggagcggacggcagtgctgaaggccgtgtgcgccggcttcaaggaagggaccgagccccgcgtctgcctcagccatgacatcgagacgaacgagtgcctgcacaggaacggcgggtgctggcgcgacgaggccaccaacgtgacggcctgccaggacacgtaccggggccgggtgtgcgagtgccccgtggtgaacggcgtccgctacgagggcgacggctacactgactgcaaagctattgggccgggcaggtgcgctctcaacaacggcgggtgctggtcggcgacgcgagggcaccagaccttctccgcctgcacggagaccgcgctgacagggtgccggtgcccgccggggttccatggcgacggccacaaatgtgaagacctggacgagtgcagggagaagctggcgtgcacgtgcccggactgccagtgcaagaacacgtggggcaactacgagtgcaagtgcaagggcaaccagctctacatccggggcgaggacgtctgcatagctaacagcatgtcgaagctcggctggttcatcaccatcgcggccgtggcgtgcgtcctcggcgtcggggtcgccggctacgtcttctacaagtacaggctcaggtcgtacatggactcggagatcatgtccatcatgtcccagtacatgccgctggacagccagaacaacgagaaccagcctctgcggcagcacgattcggaggctctgaggcactaaaggggccccaatgcaagatgcgcacatgatctcgacagatataatctgctccggtttcgacgacgatggtttgcttcgcttttgtatagcgcgtagaaaacaaaaaggaggacggtttgtactgtgccgaggacagagttgagctctagagagtttagacaggtaggcatttcgctcggctctcttgggagctagtagtcttgtgggtcaagagccgtttaaagcacacaaacagcatgtagaaaaaaaaggcgtatacgagctgctatacatgtacattgtacagtagacaaatcctactacggacaatttgttactgccatatttggtatgcgcgggagtttcaccttatgattggtaggagtaaggagtgtactatactgtactgcattaaaaattgtgtggaatgggactgcagccttgc

SEQ ID NO: 617 - DNA, 801 bp, Zea mays
ccgattccttcttcagtcttctttagattcatcagtgttgccttcttcaccgtagcagatctagtaacgctgacattgtggtcccggggtggtgccttggctgacctgaccagcgagcaaataggcccagccaactccgatcccaccggcaccagccgcccgcaacccgcaaagctgcttcccggactagctagggtttcgtctacgccgcttgatctagtcctctctcccggcacgcgaggtagggcgcagcgttgatggcggcggcaccggcggacgctaaggcggaggccgccaagatggacctcctcgaggacgatgacgagttcgaagagttcgagatcgaccaagaatgggatgaccaggaagaaggcaacgaagccgtccagcagtgggaggatgattgggatgacgatgacgtgaacgatgatttctcgctgcagcttaaggaagagctggacggaagcaacggccagaagagctgaagtattatttctctactttatataaatgatttttatatggcagctacttttggaaccgttgatgtgctttggatgtgaaagtttttggacatcagtcggcaatttgacagcactgtacgtgttagttgtcgttaggatatgtctctagccgaaacgctagaatccgccacaatgtctacgccccaactgtttctcttaaaagagtgccgcaactgtttttgtacctacgcccgacctcgttctttagcagtaatccaacagttctgtatatccactcctaaaacctccgagctaccaaatgaggattgcttgcgta

SEQ ID NO: 618 - DNA, 919 bp, Zea mays
ggggcttccagttgccaccgtgggaccgcaggcttcccttccgtgtcgtgatcctccgggcgagcggtcctccccaaaacgtgcgcgcgcgcggttccccatctcgcgcagcgctactgccggtgtcccgagsccgacaccgkcctccgsggstccgctccccgccgtgaatccttcctcctcccgcgatggagaccttcccgtyggtgaagaacatcctcctactggactccgaggggaagcgcgtcgccgtgaagtactacagcgatggctggcctactctctccgcgaagctggccttcgagaagtcggtcttcgccaaaacccagaaagcgaatgctggaacggatgcagagattgtaatgtttgatggtcaaattgtggtatacaagttcatccaagacctgcacttttttgttactggaggagaagaggagaatgagcttattttagcatcagttcttcagggattctctgatgctgtcgaacgacttctcaagaacatggttgacaaaaggacagcactcgagaatttggacctgatcctattgtgtcttgatgaaattgttgatggagggattgtacttgaaacagaaggaagagagatagctgaaaaggtgtctggtcacggatcggagggtgcttcatcggctgagcagactttagtcaatgccctaacgcaagcaagagagcatctggcgaagtctcttctcatgtgatgttgtgctttacattttgggggtgacgacggagtatctattattgtgtctggatgacacaattctttttgttagcaacggagaaagaaaaatgtctgaagcatttgaatgtgtagagtggcacattgcttccaaaattctcatggtcatctgtaagccttcaaagttatgcagcatgattgttcttatattgactggtt

SEQ ID NO: 619 - DNA, 982 bp, Zea mays
gaccgcgtcgcctctctcctcctttcgcgtcgtctccctcctccactctcctctcctctcgcgtccgcagcttcccttgccggctagggtttgcagatgacgacggcggcgcgccccacctgggcgccggccaagggcggcaacgagcaagggggcacccgcatcttcggcccctcccagaagtactcgtcccgcgacctcgccgcgcatacctcgctcaagctcagaaaagacggtcaacagacccaagaggagttacagaagaggaatctcagggaggaacttgaggaacgtgagcgcaagcactactcttccaaggataagtcctatgctgaagaaagagaccggcggaaaagctcaagccagctactcctagaaggttcaaagagagaggcagaggataagatagttccacgagaaatcgatgcagatgactccgatgtggagcctaaaagtgatgatgagagcgatgaagatggcgacgacgacgacaccgaagctctaatggcagagcttgagaggattaagaaagagagagcagaggagaagcttagaaaggagcggcaacaagcagaggaggaggccaagatgaaggaggctgaactgatgcggggaaaccctttgattaatatcaacaatcctggctccttcagtgtcaagagaaggtgggacgacgacgtggtgttcaagaatcaagcacgtggagagaccaagacgccgaaacggttcatcaacgacaccatcaggagtgacttccaccgtaaatttcttcatagatacatgaagtaatggtattgtcgtgtacaattcagatgtctccgtgctgtttatgtcagtgcattggttctctctcatcgttgttatgtttcgtgtatgagtgaacggccattgttgtgttgtatatgaaacaaaacatctgtcagcatcttaacaatgcctacctcatggtgtccaagttgatctgatttcactcacttttgtc

SEQ ID NO: 620 - DNA, 1107 bp, Zea mays
caaaagaaaaaaaaaaggccgcgacgagccgacgagcaacgacgaccatggcgacgatggccgcttcttcctgccacgggcaacttctcctgtttctcctcgtggccgtcgcgtcggcctgcctcggctccgcggcagcgcatcaagccggatctggagagggctacacgatcgctggccgcgtcaagatcgatggcacgagcgtgaagggctttggtcttgcaacaaagacatcaaacacaaaagtgatacttaatggcggccagagggttacatttgccaggccagacggctactttgcattccacaacgtgccagctggaactcatctgattgaggtctcctcaattggttacttcttttccccagttcgcgtagatatcagtgcaaggaatcctggttatattcaagcagcattgactgaaactagaagagttctaaatgagcttgtcctggaacctctgaaagaagagcagtactatgaggttagggagcctttctccgtcatgtcacttttgaagagccccatggggttgatggttggttttatggtcttaatggtctttgtgatgcccaagatgatggagaacatagatcctgaggagatgaagcaagctcaagaacaaatgaggaacaaccccgtatcattgtctggcttgctagccagagcgcagggctagaagtagcacatgaggatgctgcaagggtctagattctataatgtgtttaagggcagtactgaagtgcttgacatgccatgtcactcggagtaatttcctggggacaaggtggaaactctttcccctgtttttactgtattttaacttgcagtttttctgttagggcttgttcggttattttcaatccatatgtattggaggggattgatacggattggaggggattttgactttgaatccccctcaatccatatggattggggcagaaccgaacatggccttatgtagaaccttctgaaacctctagctgagctagtcatttggcacatcatataaccacacattgagatattcttgttcaatttgtattgtatgaatcagctgaatctaacacattgattagtcatcggaccgcggctgcacccag

SEQ ID NO: 621 - DNA, 2094 bp, Zea mays
acccgggtttgggtggcgtcgcctttcatcatttcccccctcgtgctctctctcgaaccttcttccaaagcacccgaaccctagtgatctcggaaccctagccgcgcgcggatctcggcttttccccttcctccacgccagccatggacgaggacttcgagatgcctcccgccggcgccgatgagatgatgggcgacgacgagatgggcgacttcggcggcgacgagggcccggtgatgaaggtgggcgaggagaaggaggtcggcaaggaggggctcaagaagaagctgctcaaggagggcgagggctgggagactcccgaggtcggcgacgaggttgaagtgcattacacgggcacgctccttgatgggacaaaattcgactcaagccgtgatcgtggagaacccttcaagttcaagcttggacaaggtcaagtgataaagggttgggatcaaggaatcaagaccatgaagaaaggagaaaatgctatttttaccattcctccagagctggcttatggagcatctggttcacctccaactatcccacccaatgcaaccctgcagtttgatgttgagctgctttcatggaccagtgtcaaagacatttgcaaagatggcggcatattcaagaagatccttaaagagggagagaaatgggagaacccaaaggatcctgatgaagtacttgtgaaatatgaggcccgtctggaagatggtactgttgtatccaagtctgagggggttgagtttactgtgaaagatggctacttttgtcctgccctggccaaagctgtcaaaaccatgaaaaaggcagagaaggtgctccttacagtaaagccacaatatggatttggtgagaagggtagaccagcagctggagaggaaggtgctgtgccgccaaatgcttcgctgctcattgaccttgagttgatttcatggaagactgtcacagaaattggggatgataagaaaatccttaagaaggttctcaaggagggagaaggttatgagcgtcccaacgagggtgctgttgttgaagtcaaaattatcggaaagcttcaggatggcgcggtgtttacaaagaaggggcatgacgaagagccatttaaattcaagaccgatgaagaggaagttattgccggtcttgatcgtgctgtgttgaacatgaagaagggcgaggttgctcttgtcacaattcctcctgaatatgcatttggttcaactgagtcaaagcaggatcttgctgttgttccacctaacagcacagtaatatatgaagttgagcttatttcatttgtgaaggacaaggagtcgtgggacttgaacaatgaagagaagattgaggctgctggtaagaagaaagaggaagggaatgcattgttcaaatcgggcaaatatgctagagcttccaagcgatatgagaaggctgccaagtacattgagtacgacacttcgttcagtgaagatgagaagaagcaatccaagcaactgaagatcagctgcaacctaaacaatgctgcctgcaaactgaagttgaaggattacaaggaagctgcgaagctttgcaccaaggttctggaactagacagccaaaatgtcaaggctctctacaggagggtgcaagcttacattcaacttgctgacctagagctagcagaggccgatatcaaaaaggcactggaaatcgatcctgacaacagggatgtcaagttggaatataagatcctgaaggagaagatcaaggagtacaacaagaaggacgccaaattctacagcaacatgttcgccaagatgacaaagtagcttttggggtggaggatgttgtggtgaagcgaagggattaaaaacaccgatttctgctgccgaaggacttcgcccgttgcttaacttctcgcttttcgcatactttgtagtcaattagtgtgcacggatgcttggatatgtgaaactgaggaacatgtacttcgaggattattattggttctgaatttttatgttttctggttcttgttaggaccattgaatgttctctctatataattttcggacacatgttcttaataaaccacgggagcaaaagtttatgctaaga

SEQ ID NO: 622 - DNA, 1183 bp, Zea mays
gaagaggctgttaaagcaatgaatctttttgaaggagcacaggagcacaacagggtcagcaagaggtctctcaagaactgggtggtgaatgcatttagagagcgcaaagctcttgcccttacactcaatgatacaaaaactgcagtaaacaagctgaaccagatggtcaatgtcgttgtggggataattgtgtttgttctctggcttcttattctgggaatagcaacaacacatttctttgtcttcctaagttcacagcttctcctggcagttttcgtatttgggaacacattgaagacagtttttgaggcaattgtcttcttgttcgtgatgcatccctttgatgttggtgaccgttgcgaaattgaaggtgttcaggcggtggttgaggaaatgaatatcatgacgacggtgtttctccgatatgataacctgaagatatattatccaaacagtgtacttgcaacaaaaccaattatgaatttttacagaagtcctgatatgggagaagcaattgacttctctattcatgtctcaactcctgtcgagaaactggccctgatgaaggaacgaatactgcgctacattgacaacaagaaggaacattggtacccgggtgcgatggttgtactccgggacgtcgatgacaccaacaaactgaaagtgtcaatatggctgcggcacacgctcaacttccaggacatgggtatgcggttcgtcaggcgagagctagtgctccaggagatgatcaaagtcctgaaggacctcgagattgagtatcggatgctgccacttgatgtgaatgttcggaatgctcctccaattcagtccacaaggatgcctacaacatggagttattcgtgaatcagtgacagggccggaccatttggccgtgacgttgcagatgcggacttgctatggatttggtggtcttaagctgcaagaactggtggtagcacaagcggattaagctgcaggtgcttggtagcaaatattagaggtagagaatagtagcatattagctagcatgtagaaagctgttagctgtgcctgcagtcgtcacttgtgcaacttgtaattactgtattctcttgcgtgatgataattttctgtacatttgatggggaaatgatggtttggaaagagaagcaattgaaggagatgacatggtaatgtgtatgca

SEQ ID NO: 623 - DNA, 1193 bp, Zea mays
ctctatcccgttcccttccgtccctcgtcacgctcacgaagcacgctgtcgtcttgcggctctcgcccgtcgccccccgagccccgaaaccaaagccgagccgagagcccgagccccgccccgacctcatcttctcctcgtcggtttcacccctccaccacctccatggggtcgtcggaggccgacgaggaccagctcctcaagagcttcctcgcggaggtcagcgaggccgagcgggacaacgaagtgctgaggatacttggttgcttcaagttaaaccccttcgagcatcttaagttgtcttttgattcatcaccagatgaggtgaaaaagcaatataggaagttgtcattgctggtccatcctgataaatgcaagcatcctcaggcacaagaagcttttgcagctctggcgaaagcacaacagctcctgcttgatccacaggaaagaggctacattcttgaccaagttactgctgcaaaagaagaattgagggcaaaacggaaaaaggagctgaagaaagacagtgcgtccaagataaaatctcttgtagatgagggaaaatatgaagagcagtttgaacgatcggatggatttcagcagcaattaataattaaagtacgtgaaattttgaccgacaaagaatggcgtaggagaaaaatgcaaatgaggatatcagaggaagaaggaagacttaagaaggatgaggaggaaacaaaagagatgtggaagaggaagagagagcatgaagagaagtgggaggagaccagagacaagcgggtctccagctggagggatttcatgaagacaggaaagaagggacggaaaggtgaaatcaagcccccaaaactgaagactgaagatccgaacaaatcttatgtgcaaaggccagtaaagcgaaactgagtggaatgtcagcaatcaaagaacatccggtagcggcctttcatctcaccagattagagctgcaacccttcaatgttgtacttgtcctgaatgtggtaaggttcaattacgcccgctgggaaacagaacggaacagagcagattttacccgtattgctagctagagtgatttggtttgatgtactcatcatccgtctgaagattttactgggaaaaaaagtacaaacttttccgttggaaaagaacctaatgaagtgaatgttgacaggccgtctctttactgcttc

SEQ ID NO: 624 - DNA, 517 bp, Zea mays
cgtccggctcctgctgcagcgcggtgcacgccatcgggaagcagagccccaggtgcctctgcgccgtcatgctgtccaacaccgccaggagcgccgggatcaaggccgaggtcgccatcaccatccccaaacgctgcaacctcgccgaccgccccgttggctacaagtgcggagattacaccctgccatgagcggcggtgagttctccaggccggatttgctgcatggcatgcccgagtatcagtgtatcaccgaagcgcgagcgcctcttgtgtcgagcgagtccgtgtctgtcagtcagtctctatgtgttgcccataataaacaagacaagcgagtaccagacatgtgcaactctagtagtatggtgcgtgttatcactaggtacgcgtactcgtatatttgtgttcagttcaaggtctatagagatgtagccctgcattgtcgaaataaatactgtgtccactcgttcgtgaaatgaaaaaaaaaggcttgatgctcgactaaaaaaaaaaaa

SEQ ID NO: 625 - DNA, 629 bp, Zea mays
gaaaaaggccgcgacgagccgaccagctctactgcccccttccggccttcggcgaccgtgacgagcaacgacgaccacggtgacgatggccgcttcctccctctgccacgggcacttgctcctgtttctcctcgtgtccgtcacatcggcctgcctcggtaccgcggcggcgcatcaagccgggtctggagagggctacacgatcgccggccgcgtcaagatcgatggcgtgagtgcgaagggctatggtcttccagccaagacatcaaacacaaaagtgatacttaatggcggacagagggttacatttgccaggccggatggctactttgcattccacaacatgccagctggaactcatcttattgaggtctcctcaattggttacttcttttcccctgtccgagttgatataagtgcaaggaatcctggatatattcaagcagcattgactgaaaccagaagagttctgaatgagcttgttctggaacctctgaaagaagagcagtactatgaggttagggagccgttctccgtcatgtcacttttgaagagcccccatggggtttaatggttggttttatggtcttaaatggtcttcgtgatgcccaagatgatggagaacatag

SEQ ID NO: 626 - DNA, 1773 bp, Zea mays
caacttgcacgctccggcagcgaagctcccccctccctgcctccttccccggcgccccgctcttcctccttccgctccggcgatgggcactggccgccgcggcggcggcggcggcggcgtgttccaccgcctcctcgccctctcgtcgctgctgctcctcgcttccggcgaggtcgtcttcgaggagcgcttcgaagatggttgggagactcggtgggtggaatccgactggaaaaggagtgaagggaaagcaggaaggttcaagcacacagcggggagatactctgcagatcctgatgacaaaggaatacaaacaacaatagatgccagacattttgctatctcagccaagttcccggaattcagtaacaagaaccggacgcttgtggtccagtactccattaagtttgagcaggatattgaatgtggcggtggctatattaagcttatgtccggttatgtcaaccagaaaaaatttagtggggacactccgtacagcttgatgtttggaccagatatatgtggtactcaaacaaagaagctccatcttatactctcttaccaggggcagaactatcccatcaaaaaagatctagaatgtgagacggacaagttaacacacgtgtatactttcattcttaggcctgatgcatcttatagcctgcttgttgataaccgtgaaagagaatctgggagcatgtacactgattgggatattctccctcctcgtaaaattaaggatgttcacgccaaaaggcctaaggattgggatgacagagaatatattgaagatcctgatgaagttaagccagagggctatgattctatcccaaaacagattcctgatccgaaggacaaaaagcctgacacatgggatgaagatgaggatggaatatggaagcccagaatggtatcaaatccagcatacaagggaccttggaaacgcaagagaattaaaaatcctaactacaagggtaaatggaagaccccatggatcgataatccagagtttgaggatgatccagatctttatgtgctgaagcctttgaagtatattggaattgaagtttggcaggtaaaagctggttcagttttcgacaacattctgatttgtgatgaccctgagtatgcaagaaaggttgttgaggaaacttggggtgcaaatagggaggctgaaaaggaagcttttgaagaagctgaaaaggagaggaaagctagggaggatagggaaggtcaaaaggcaaaggacgatggtggccggcatcgaatacacaggcgtcataaaaaacactacagagatcactgggacgactaccatgatgagctataaaagtccccaaatattgcattcctcaaaagcataagctggaagttgcttcggacattgtgggtgcttttcaataataataattgattcgcctggtcagaacaacctgaagtgtttcttgctatgcgccaacaaattattgaactacaggatttgatatgtaatggacaaccgaagatctgcagggcattccagcgaaaacttggctctggtactgaaatagaggggacgagagactgtagtttgtgtctgtacaacggtgccggccatgtgctagctttgtaatctcaaaacattgtctttgcatgaataatgtaagttacccaaaaattactgcataccaagttacaaagtgttgtagctgacatatgaggaacactttaattttaatcttcatatatatacttctgtaatcttcaaaaaggatacgatgcaattggtctatc

SEQ ID NO: 627 - DNA, 634 bp, Zea mays
ccttaccagcacacagtggagctagctagctagtagagaggtcaatcaccaatggcgaggcagctcgttgtgcttgctctgcttttcgtgatcgccggtgtggcgcatggcgcgggggagtgcgggagagcctccgccgacagggtggcgctaaggatggcgccatgcatctcggctgccgacgacccgcagtccacgccgaccagcagctgctgctccgctgtgcacaccatcgggcagagccccagctgcctgtgcgccgtcatgctgtccggcaccgccagggctgccgggatcaagccggaggtcgccattaccatccccaagcgctgcaacatggccgaccgccccgtcggctacaagtgcggagattacacgctgccctagctgatgaagacgtcgtcaacgagaccgtgcgagtgaaccagtgcatgaacgaatgccattatgccatgcaactatgttgcgttgcgttgttggaataataatcgaatccgctagaataaatatgtacgtgcacgacggcctcttgcttgtatcactggactttgcttgtgtgttatacgtcaaatatgttccgtttctctcatataagaaaattatgcaatgcttgttattaacctaattcattgca

SEQ ID NO: 628 - DNA, 1144 bp, Zea mays
cgaagtgcaaccatccgtcacatcacaaaccgaaaaaggccgcgacgagccgaccagctctactgcccccttccggccttcggcgaccgtgacgagcaacgacgaccacggcgacgatggccgcttcctccctctgccacgggcacttgctcctgtttctcctcgtgtccgtcacatcggcctgcctcggtaccgcggcagcgcatcaagccgggtctggagagggytacacgatcgccggccgcgtcaagatcgatggcatgagtgagaagggctatggtcttccagccaagacatcaaacacaaaagtgatacttaatggcggccaaagggttacatttgccaggccagacggctactttgcattccacaacgtgccagctggaactcatctgattgaggtctcctcaattggttacttcttttcccctgtccgagttgatataagtgcaaggaatcctggatatattcaagcagcattgactgaaaccagaagagttctgaatgagcttgttctggaacctctgaaagaagagcagtactatgaggttagggagccgttctccrtcatgtcacttttgaagagccccatggggttaatggttggttttatggtcttaatggtctttgtgatgcccaagatgatggagaacatagatcccgaggagatgaagcaagctcaagaacaaatgaggaacaaccctgtatcattctctggcttgctcgccagagcgcagggctagagaagtagactgtagacatgaggatactgcaaaggtcaaacattctagaatgtgagtaagagcactattaaagtgcttggcacgtcactcactcggggcaatttcctggggataagaaggaaatcttttccccctgtttttaccgtattttagggctagtttgggaacaccaatttcccaaaggatttatatttttccatgggaaaatgaactaatttcccttgggaaaatgaaaatctcttggaaaattggggttccaaactagcccttaagttgtaatttgtctgcsgtgtagaaccttctgaaacctctgagctagtgatgcgtcagattgagatattttgttcaatgtttgctgtttgaatcaggtgaatctttgaccccttgcttagtcatcacga

SEQ ID NO: 629 - DNA, 1360 bp, Zea mays
catttttatgcacgcccagcacgcccagacggcggaggaagggggaaagaggagggcagagcagcaacagtacatcgagcgagggagtagagtaaattgaatcaggtttcgtgtcgattcggaggctttcgcttctgcttgcggagttgcggtggagatttgaggcctgcggcgaagatggcacctgcggaatccggggagaaggcgaccagcttcgccatggcctgcagcctgctcagccgctacgtcaggcagaacggtgccgccgctgccgatctcggcctcgctatcagagctgaatccgatgcaaagaggacgtcgacggacatggaaaagggggagacggggaaggagaccatggatctcttcccccagatcgctggattcggctcggaggccgccacgaaggaagcccctgatgcgagggagccagagaagcgccagctgactatcttctatggcgggaaggtccttgtgttcgatgacttccctgctgagaaggcaaaagacctgatgcaaatggccagcaagggttcacccgtagcccagaaccctggcctgctgcctccctccacagctgcaaccgttactgacagcaccaagatcgcagcagtgccagccgcaccaattgctgtggccaacgcccagaagagtgcagcagatataccgcaggctcccaaggcatctcttcgcaggttccttgagaagagaaaggatcgccttactgcgaaagcaccatacccgggttccccttcagatgttacacctgtgaagaaggagatgtcggatggtcagccatggcttgggctgggacctcagatcgccaaccctgatctgagcttgtccaaggaggcgagccagtgatcgatgatccagcatcaccatcttcaaaactgcgatactcaacagccatgtgtggaagtgttctgttttgggcccctatcattccgggttttttttcgcatggataaataggttgtacgaaagtaaagaacacagctaatgacggacttcagtaaggattaccggcgctggggcaggtttggctgatcagcctttgctggcctgacccaagtggccattttagaaagatgaaaatgtaatgtagtagttgctagaacaagttggcatcttgggatgttctgtgttgtttggctttggcactggtgcgtgtcagtgtcacaaagctatttattttcacagatacatgctatatgattttttttattatcttctggttgtctctgtagggttatgaaatatcacagcttttctttctaagtgattgtgatcaatgcccctggactatcagaatgttgttctctgaagttacaatctactactcccgttgatctagtaa

SEQ ID NO: 630 - DNA, 615 bp, Zea mays
tcggctaaagagatacaaatacttttattgaatattttatgtggatatataccgaccggtacctagttcgtcatataagccgtaactactacacaaaacacaagttacacaaccccggctcccgctggcgcacacgctcctcacgtgccgcacccgaaacgtcccaagaaaaaagggagaaaactcaccgaaaagtctacccacctgggccctggccacctcccccctgctcgctcacgacccccaacacgcgagtacgcgacgacgcccctcacaaaaacaggggccaaaaaggataaaaaaaagtggggaaaagaacgccgggaatgggcaagcagcagcatccttaccagcacacagtggagctagctagctagtagagaggtcaatcaccaatggcgaggcagctcgttgtgcttgctctgcttttcgtgatcgccggtgtggcgcatggcgcgggggagtgcgggagagcctccgccgacagggtggcgctaaggatggcgccatgcatctcggctgccgacgacccgcagtccacgccgaccagcagctgctgctccgctgtgcacaccatcgggcagagccccagctgcctgtgcgccgtcatgctgt

SEQ ID NO: 631 - DNA, 1923 bp, Zea mays
attcgtctgggaaagcaccactttctgaggttcctgaaagttccaggacaaatgttgttgggacaagctctgtagtccgttctttgttcagtgcttcttcgtcatcagtcagttcatcaccagaaaagcagccgacagagaatgaaaaaatggtcaatgaaatgcttcatgaggatgccagtgcttttgctggcaggtctgatagtgctagtactgctgaggaggagttccagaacaaagtgagagaaaccatggagaaagctttctgggatatggtcaccaactccatgaggggagaaagacctgattatagtcaattgatcaacctagtaaaggaagtgagggattcgttgcatgacctggctccaaaagaatggaaggagaaaattcttgagaacattgaccttgaaattctgtctcaggtacttgggtcaggttcccaggatgcacaatacttggggcagattttggagtattctctggatatggttcgcaagctctctgctgctgcaaaggaggatgagatgaagaaaaaccatgataaattattgagtgaattgtctacgaattctgaagttaacggcgatggcatcaactcatttgtcattgctgttatcaagggccttcgtttcatcctggaagaaataaaggaactgaaagcagaagtgagtaaagcacgtatccagatgatgcaacagatcataaaagagtcggctggggttgagtacctgcagaaggcttttgctgatcgctatggacctcctgagacagcaccagcttctcttcccctaactctgcaatggattttgacatcgaagaacattgcggaagaagaatggagtgaacattcagactgtctttcagtaatgccagcagcagggcaggctcctgctcttgttccggtactccgatctggtcatggagctccagtagggcaaccatctccttctgcaggagacacctctggtcaaccagagtgcaagggtgagaagcttgacaagctaataaggattggcctgttgcaactcattagtagtgtggagggcttgcaattgcagtcaactcctgaaagttttcagattaatctgctgaggctgagggctgtgcagagccaattccaacaggtgatcgtgatcgccacaagcatgctcgtcctgcgccaagttctgatgagcgagaactcgagggccactcctctggaactggaaaatgccatctcagaactcgtcaaggctctcgcggacatactgcacagctcacccgattccggcacggaagagattgtgcaggcgatggtcaatgcatcagcctcagttggctcaccatcagaggagaaggttcaggccaggatgcagatgatcacccgggtgttcctcaagagcctccagcccggtgacgtggtcttcaagaaggtatcccgtgcggtctactgcgccttccgtggcatcatcttaggtggcagtggtcccaagggccagaagctggcggacgctgcattgcgccgcatcggcgccaccaatgttgtcgacagggtgttgaaggctgctgaggtgctgatcaaggtggcaacggtatcagagaaggtccacggcccctggtacaaagctctgatagtctgatgtgagcatgaatgtgaatggtttggcttttgtgaatacagacggtgaaagtgtaaatccttgttccactgggtgggatgggagatatggtgttgtacagcaatttatagttgttggtcagtaggcagttcaggatgtgaagaattctggtgagctgggcgaatatggatgctctttcaccaggatttagtcaggctcgatggatggatgctaaaacgcgtctggaaatgtaaattgtggcaccttgtttgattttcgaactgaaataatgtaaataattgattgcaagttatttgtgctctgc

SEQ ID NO: 632 - DNA, 1629 bp, Zea mays
gtggcagtggagtagtggtaggaaaagctcgtcgccgagtcgccgtacgggggctcggctcgggtgagcgagcggcggccggcgggtactgaggcctgagggcgaggcgatgggccgcctccgtgacgggcgagccttcctccaccgcgcgcttgtcctctcgtcgctgctccttctcgcctccggcgaaatcttcttcgaggaacggttcgatgatgggtgggatagccgctgggtgaaatctgattggaagaagagccaaggacaagctggaaccttccgacacacagcgggaacctactctggagaccctgacgataaaggtatacaaacaactggggatgccaaacattttgctatatcagcaaaattcccacaatttagtaacaaggaccggacattggtgatccagtactctctaaagattgagcaagatattgaatgcggtggtgcttacatcaaacttatgtctggttatctcaaccagaagaaatttggtggcgacactccttacagcttcatgtttgggcctgatatatgtggggatcagaaaaagaagctccatctcatactttcataccaagggcaaaactaccctatcaagaaagaactaaaatgtgaaacagacaagttgacacatttttacacatttattcttagacctgatgccacttatagcatccttatcgataaccgggagagagaattcgggagcatgtacactgactgggatatccttcctcctcgtaagatcaaagatgttaatgcaaaaaagccaaaagactgggatgacagggaatatattgaagatcctgatcaagttaagccagagggatatgattcaattcctaaagagatacctgatcccaaggacaaaaagcctgagtcatgggatgacgatgacgatggtacatggaagcctagaatgatacctaatccagaatacaagggaccatggaagcggaagaaaattaagaatcctaactacaaaggaaaatggaagaccccatggattgtcaatccagagtttgaggatgacccagacctatatgttctgaaacctttgcagtatgtggggattgaagtatggcaggtcaaagctggttcagtttttgacaacattttgatttgcgatgacccagactatgcaagacatgttgtagatgaaacttttgctgcaaataaggaggctgaaaaggaggcctttgaaggagctgaaagaaagaggaaggctagagaagaagaggaagcacggagggcacgggaggaaggggagagacgaaggcgggagagggatagggaccgcggcagggaccgatacaaggatagatataagcgtcataggcactacgactaccatgacgagctatagatcctgtattcttttgaaatctgcacgatattggatgtctgtctacggagagcgcacgtgcaaaacttgtatgttgtactcacggatgaagctgaacctgtgattttggcgatgggtagagattggccatcgcgtctgtaactaaatttccacgttgcgatgcaatatgagctgtagtactgtcctcgcactactatttaccgtttgtgctgcatatgtgatataaaccttcaagaaacacacacacgaagggtctg

SEQ ID NO: 633 - DNA, 1269 bp, Zea mays
ctctatcccgttcccttccgtccctcgtcacgctcacgaagcacgctgtcgtcttgcggctctcgcccgtcgccccccgagccccgaaaccaaagccgagccgagagcccgagccccgccccgacctcatcttctcctcgtcggtttcacccctccaccacctccatggggtcgtcggaggccgacgaggaccagctcctcaagagcttcctcgcggaggtcagcgaggccgagcgggacaacgaagtgctgaggatacttggttgcttcaagttaaaccccttcgagcatcttaagttgtcttttgattcatcaccagatgaggtgaaaaagcaatataggaagttgtcattgctggtccatcctgataaatgcaagcatcctcaggcacaagaagcttttgcagctctggcgaaagcacaacagctcctgcttgatccacaggaaagaggctacattcttgaccaagttactgctgcaaaagaagaattgagggcaaaacggaaaaaggagctgaagaaagacagtgcgtccaagataaaatctcttgtagatgagggaaaatatgaagagcagtttgaacgatcggatggatttcagcagcaattaataattaaagtacgtgaaattttgaccgacaaagaatggcgtaggagaaaaatgcaaatgaggatatcagaggaagaaggaagacttaagaaggatgaggaggaaacaaaagagatgtggaagaggaagagagagcatgaagagaagtgggaggagaccagagacaagcgggtctccagctggagggatttcatgaagacaggaaagaaggttagaatgtgtatatggcaagtagtatcttcctatgcatgatatatttttttaactgaaactccttcctctgcagggacggaaaggtgaaatcaagcccccaaaactgaagactgaagatccgaacaaatcttatgtgcaaaggccagtaaagcgaaactgagtggaatgtcagcaatcaaagaacatccggtagcggcctttcatctcaccagattagagctgcaacccttcaatgttgtacttgtcctgaatgtggtaaggttcaattacgcccgctgggaaacagaacggaacagagcagattttacccgtattgctagctagagtgatttggtttgatgtactcatcatccgtctgaagattttactgggaaaaaaagtacaaacttttccgttggaaaagaacctaatgaagtgaatgttgacaggccgtctctttactgcttc

SEQ ID NO: 634 - DNA, 1973 bp, Zea mays
ggggcagagctggcaagtggcaaggctgcgcagagggactttttgtgtaaaatgcggtgggaaggtgcgctgcacctgcaagcagaggtgtgctctactgacagagtttgaactcaagaggaggcgaggcagaaccgcaatcgcgaccgcgacccgcaggtgacatacatacggtgcgagcgccggaagccggaagcaccggtgacgaagccttccgtgtcatcactcatcaggatctcagggttttgtttcgtttcgcgggcgttgggaatccatccatggcgaggaagatgctcatcgacggggaggtggcggccgtcgcggatggtgggcactatgactacgatctcttcgtcatcggggcgggcagcggcggcgttcgcggctctcgcaccgccgcctccttcggagctaaggttgcgatttgtgagctcccattccaccccatcagctcagagtggctaggaggacatggtgggacttgcgtgatacgtggttgcgtacctaaaaagatactcgtgtatggtgcatcattccgtggagaatttgaggattcgaagaattttgggtgggagattaacggagatattaacttcaattggaaaacgctattggaaaataagactaaagaaattgttagattaaatggtgtgtatcagaggatccttaccagtgccggtgtgacaatgattgaaggggcaggcagtctagttgatgctcatactgttgaagttagccagcctgatggttcaaagcaaaggtatacagcgaagcacattttgatcgcgactggtagccgtgctcaacgtgtcaacatacctggaaaggatctggctattacttctgatgaggccttgagcttggaggagcttccaaagcgcgctgtaatcctgggtggcggatatattgctgttgaatttgcttctatctggagggggatgggtgctgaagtagatttgttttatcgaagagatcttcctctaagaggttttgatgatgagatgagagctattgttgcaagcaaccttgagggaaggggaatcaagttgcatccagggacaaatctctctgagttgagtaaaacggctgacggaataaaagttgtaactgataaaggagaagagctcattgcagatgttgtcctatttgcgacagggcgcacaccaaactcccagagactgaacttgcaagctgcaggcgttgagattgaccgggttggagccatcaaggttgacgaatattctcgtacttctgctcctagtgtatgggctgtgggtgatgtaacaaaccggattaatttaacacctgttgcattgatggaggcaacttgctttgctaaaactgtgtttggtggccagcaagttaagcctgatcacagagatgttccttgtgctgttttctccattccaccactatctgtagtgggcctcagcgaagaacaggccttggaggaagctaatggtgatattcttgttttcatctcatcattcaacccaatgaagaacagcatatccaagcgccaggagaagactatcatgaaactggtagttgatgctgaaactgacaaagtacttggtgcatccatgtgtggaccagacgcacctgaaattatccagggcatcgctattgcggttaaatgtggagccaccaaagcagacttcgacagcactgtcggaatccacccttccgctgctgaagagttcgtgaccatgcgcaccgtgacgaggcgcttgagcccgacatccaagccaaagacgaacttgtaagcaagaaattggtattctggggaaatgttacaccggacaaatactctggtttcatcacgttggtaatttttacgtcattggaactggaaccatgtatattgaaggaataagttgtttttttcatggcaacacaccgaaaataatgagaccgtggactttcttgatacaaataatgagctcaagcagagaacgtttatggttggttct

SEQ ID NO: 635 - DNA, 1221 bp, Medicago sativa
actaaaccctcgattctggaaactaacttctccctcactctgagattttagccatagaactctctcgaaacccttcaacaaactcttctccatttccatttatacccttctccttcgccaaatttccacatacttcacgcatttctcgaacctttcattcatcactcatctccgcattctctcatggacgaagatttcgatattcctgcggttgattctatgaacgacgatttcgacttcgccggcgccggcgataatccaattctcaaggtcggtgaggaaaaggaaatcggaaagcaaggtttgaagaagaagcttctcaaagaaggtgaaggttgggatactcctgatgttggcgatgaagttcacgttcattataccggaacgttgcttgatggtacgaagtttgattctagcagagataggggaactactttcaatttcacgcttggacaagggcaagttattaaaggatgggatgagggaattaaaaccatgaagaaaggtgaaaatgctcttttcaccattccacctgagttagcttatggtgaatctggttctcctccaactattcctcctaatgctactctgcaatttgatgttgagctgctgtcttggactagtgtgaaggatatatgtaaggatggaggattgtttaagaagatagttaaggagggggagaaatgggaaaacccaaaggatcttgatgaagttttagttaagtatgaagcgcgtcttgatgatggaacactagtagcaaaatctgatggagtggagttcacagtgaaggagggttatttttgtcctgcattgccaaaggctgttaagactatgaagaagggagagaaagtgatcttgactgtgaagccacaatatggatttgatgagaaaggcaaaccagctcatggtgatgaaggtgcagttccacctaatgcaacattggagattacccttgagttagtttcttggaagactgtttccgaagtaactgatgacaagaaggttwtcaaaaagattgtcaaggaaggagaaggatatgagcgtccaaatgatggagctgttgtaaaattgaaactaattggtaagttgcaagatggcactgtctttttgaagaagggccatggcgatgatgaagcagagctgtttgaattcacaacagacgaggagcaagtgattgatgggctcgatagagctgtaatgaccatgaagaagggtgaggta

SEQ ID NO: 636 - DNA, 1451 bp, Medicago sativa
atttcgtgccctaaaatcacagatcccaataatcgttttttcttttctctctctttctcaggaaaattaaattctctctaattttctcgagaaagtttggatcatcgaattgaaggaaaaaaaaaaaacacaatcagagaattatgagcttccaggatattgaagctggccggccgttcggttcgagacgcggcggaccgatcaacgggaagcaagacccaacgcaagcggtggctgccggaatttttcagatcaacaccgccgtttcgacgtttcagagacttgttaatacccttggaacccccaaagatacccctgagcttcgtgaaaagcttcacaagacaagacaacatattgggcagttggtgaaggatacatcagccaagcttaaacaagctagtgacattgatcaccatgccgatgttaatgcaagcaagaaaatagcagatgctaaactcgccaaagattttcaagcagtgttgaaagagtttcagaaggcacaacgtctttcagccgagagggaaacagcttacactccttttgttccacaagcagttcttccttcgagctacacagctagtgaaatggatattggtactgataagacaccagaacagcgtgcccttcttgtggaatccagaaggcaggaggttttattcttagataatgagattgcattcaatgaggcaatcattgaggaaagggagcaaggcattcaagaaatacagcagcaaattggtgaagttaatgaaattttcaaagatcttgctgtgcttgtccatgaacaaggaaccatgattgatgatattggttccaacattgagaactcccatgcagcaactgcacaagcaaagtctcaacttgcaaaagcttcaaaaacacaaagatcaaattcatctttggcatgcttgcttttggtcatatttgggattgtgcttctcatcttgatcatagttcttgctgcttagtcaatgattctattaattccaccatggtactaatgcatatattcggagagcagcagatagaatctcccttgttgatgatgtcacttaagtggtgttttactgagtctcggttgattggagtttgacgtagctgatttcagtgcatgatgtgggaattcccttcagtatattgtgattttgttatggggtgttatgttctctcttatgttggtgtttggggttttaaggatgtgtcaacttgtgctgcaagctctcttctagtttcgtcaatataaagaatatattaattctttgactttcctttacttgtaaatgcaacaccgaaattcgcagtgctgactcctcagcaagacattgatttatgataatctgttttcttttgtagttttttttttctttccaaaactgaaagcttcaagtttgcttgggtaggtctaaagactgtatggagtaaaatagatgtactattttttataatttgtg

SEQ ID NO: 637 - DNA, 1897 bp, Medicago sativa
ggcacgaggaaaaattcgggggtgcaaatacaacacctggtggaggtgcaaataacaaactccttaacagacaacgtatcacacttcttctccatttctttttcttacatctcctctctgcaaattcatttctacgaatcgcgttcttctttctcttcattcattcatcaatcttcatcacaggttttggaaaaagtttttgattgtgatggctagaaagatgcttaaggacggtgaacctgatttgaacaaaggtgcagaagaagggacgaattttgactttgacttgtttattattggggctggaagtggtggtgttcgtgctgctagattctcatctaatcatggagctaaggttgcaatctgtgagcttccttttcatccgattagctcagaaacgattggaggagtcggtggaacgtgtgtcattcgtggttgtgttcccaaaaagattttggtctatggagcatcttatggtggtgaccttgaggatgctagaaattttggatgggaattgagtgagaatattgacttcaattggaagaagctcttgcaaaagaagacagatgaaataaacagattaaatggaatttacaagcggttgttatccaatgctggggttaaactatttgaaggtgagggaaagatagcgggtccacatgaagttgaggtgacacagttggatggtactaaattgtcctattcggcaaagcatattttgattgcaactggcagcagggctcaacgtccaaatattcctggccaggagttgggtataacatctgatgaggctctaagtttagaagaatttcctaaacgtgttgtgattcttggaggaggttatattgcagttgagtttgcatctatatggcgtgggatgggtgccaatgtcaatctcgttttcagaaaggaacttccattgagaggttttgatgacgaaatgagagctgtagttgcaagaaaccttgaaggcaggggaattaatttgcatccaaggacaaatttgacacagttgatcaaaacagaggatggcattaaagttactacagatcacggtgaggagttgattgcggatgttgtgctatttgccactggaagggcccctaattctaagaggttaaatttagaaaaagcaggcgtagaggttgataagacaggagcaatagtggtaaatgagtattcatgcaccaacatcccaagcatatgggctgtgggtgatgtaaccaaccgaatgaatcttaccccggtggccttgatggaagcatcacattttgcaaacacggtatttggtgggaaaacacagaagccagattatagggatattccatatgcagtgttcagtattccaccactttcagtagttggtctaagtgaggaggaggcagtagagcaaacaaacggcgatttattggtttttacgtcaactttcaatcctatgaaaaatacaatctctgggcggcaagagaaaactgttatgaagattgttgttgatgctcagacagataaagttcttggagcatctatgtgtgggcccgatgcacctgaaattgttcagggtattgctattgcattgaagtgtggagctactaaagcgcagtttgatagcacggtgggaatacatccatcggctgcagaagaatttgtgaccatgcgctcagtgacaaggcgtgttactggtagtgcgaagcccaagacgaatttgtaaacacattttaattaattagctaaataagatcagttcaaattggtcaggacttgtttgtatgtttcttttattgggcatagccccttcgattttgtaaaatactaatcaaaatataaactgtttgttcatagtgtagctgcaatacaaaaatgtctgttttttcagataaataaagagtgttcttttatagca

SEQ ID NO: 638 - DNA, 1239 bp, Medicago sativa
ggcacgaggcagaaactcaaagtactatcatcgaatcaaaatcaattcctaaaagaaaaagaaaaaaagaaaaaaaaaaccctaaaaaatgggagaatcaaactcatccaccatcatcgaagacgatttacttctcaaaaatttcttcgctgaagtcagcgaagttgaaagagacaatgaagtcctcaggattctgggttgttttaagttgaatccgtttgagcatttaaacctatcatttgattcatctattgatgaagtgaaaaagcagtacagaaagatatcattgatggttcatcctgacaaatgtaaacatccacaggcaaaggaggcttttggagcactagcaaaagcacaacaattattactcgatccaaatgaaagagattatcttcttagccaagttaattcagcaaaagaagaacttagagtaaagagaaagaaacatctgaagaaagatacagcctcaaaaatgaagtccttagttgacgagggaaaatatgataagcaatatgaacagtcagaagaattcaagcaggagctcaaacttaaagttcgtgaactattaacggaaaaagaatggaggagaagaaaaatgcaaatgaggatatccgaggaggaaggcagattaaaaaaggatgaggaggaacagaaagaaatatggaaaagaaagcgtgagcatgaagaggaatgggaaggaacaagagaaaagagggtatccagctggagagattttatgaagggtggaaagaagaacaaaaagggagaaattcgcccccctaagctcaagacagaagatcctaacaaatcctacgttcagaggcctgtaaaaagaggctagggtgtttggtcacaggcgatctattcaacaggagtcaaagaaaacttagccatgcgccctttgtgtcagtttgatattgtaatgatgtttatctctagggtcatgagaggcatctcaatggaatgtagacctccaaatgaattctgattattattttgccctagcactgattgatacataggaggaattatcaaagttgtattgcctttacaaagggttttttagaaattgtgtaaactatttatataccagtcatctgcagtgagccagattttaggttagacactttgatgtaagaagaaaaaaaatcattctgatttagttaccgttcaatgtaaaatacccaggtaacctatatcgatgattttaaaacaccattgcagttatttaacttttct

SEQ ID NO: 639 - DNA, 2130 bp, Medicago sativa
gcaaagtctttccctttagaactctatcatctcactctcacacagacaaagtaagatcaaaaacccatcttccttctctacaagtgcaagattctgaacacgatgaacgacgacttcgaaattccacaagctgaagaaatgaacgaagacttcgatcttccagaagagaaggtaggcgatgagagagaagtcggcgatcgtggtctcaagaagaagcttctcaaacttggtgaaggttgggatactcctgaatccggtgatgaagttcaagttcactacactggaactttgcttgatggaactaaatttgattcaagtcgtgatagagattctcctttcagcttcacgcttggacaagggcaagtaattcaaggatgggatgaaggtattaaaaccatgaagaaaggtgaaaatgcactcttcaccatccctcccgagctagcttatggtgaatctggttcacctccgacaattcctcctaatgcgacgctccaatttgatgttgagatgttgtcttggaccagtgtgaaggacatatgtaaagatggtggtatatttaagaggatacttaaagagggggagaaatgggagaaccccaaggatcctgatgaagtattggttaattatgaggttcgtctggaggatggaaaggctgtagcaaagtctgatggagtggagttcactgtcagtgagggtcattattgccctgcattctcaaaggctgttaaagccatgaagaagggagagaaagtgattttgttagtaaagcctcaatatggatttggtgagaaggggaagccagcgcatggtgatgaaggtgcagttccaccaaatgcatcactgcagattacacttgagttggtttcttggaagactgtttcagatgtgactagtgacaagaaagtcataaagaagatcctcaaggaaggggaaggatatgagcgtccaaatgaaggagccatcgtaaaattgaaactaattggtaaactgcaagatggtactgtcttttttgaaaagggccatgatgaagaagagaagctgtttgaattcaaaacagatgaggaacaagtcattgatgggcttgataaagctgtattgactatgaagaagggtgaggtagcattattgattattgctcccgagtatgcatttgattcatcacagtcccagcaggagttggctgttcctcctaattcaaccgtgtattatgaagttgagctagtgtcatatgagaaggagaaggagtcttgggatatgaatactcaggagaaaattgaagctgctggtaagaagaaagaagaagggaatgttttgtttaaagccggtaaatatgaaagagcttccaaaagatatgacaaggctgcgaagtacatagagtatgattcctccttcagcgaggaagagaaaaagctgtcgaagaccttgaagattgcctcttatcttaacaacgctgcttgcaagttgaagttgaaagagtacaaagatgcagagaaattgtgtactaaggtgttggacattgagagcacaaatgttaaagccctctatagaagggcccaagcaagtatgcagttaactgacttggatttggccgaaattgacatcaaaaaagctcttgaggttgaccctgacaacagggaagtaaagctggagtacaagaatttgaagcaaatggtaaaggagtacaataataagcaggcaaaattctatggaaatatgttcggcttgagaaaggcttgatcctgatagaaattttagcatgccattatgtttcaaaaacctactatagacgctactgaatccgtgattattgacaacaaaatccgatcaagttgagtatctgacaacaaaatccgatcaagttgagtatctgtcttccatgggtttttgatcgtcattgtatcatttatggtttatggattatgggaaaaaatggcgttggaaaaaaatggtgttggacgttcatttcgtatttcatatttgagttaacataattgacttgatttgctttgatttgatttatccccatctactgtagtgattgtataagaactattagtgatgaaaacgggctaagctaaggattgtttaaagtttaatgttaaacgttttatttcattcatatttggctgc

SEQ ID NO: 640 - DNA, 948 bp, Medicago sativa
tttattttgtttttcttgatcagtagaaaatgtggaacagaatgaattttcaagaagaagcagttcagattatgaactcagatttcaaagacctgagtgaagctgctagtaaactcgctaatcatgccatcaaattagctggtgtaggcggctttggagcttctttcttcggattctttgctgctgttgctgctatatatttgttggttttggatcgcacaaactggaagacaaacattcttacatcactactcattccatacattttcttcagcttgccttcttttgttttcgctgtattcagaggagagattggaaaatggattgctttagttgctgttgttttaaggctttttattccaaagcatttcccggattggttggagttgccgggtgctttgatacttttgattgttgtatctcctgatctagttgcaagcacctttagaaacgaccttgttggagtaattgtgtgccttgtcattgcatgttatttgctacaagagcatattcgtgcatctggtggtttcagaaactccttcactagagcaaatggcgtatcaaattccattggcataattcttctgttagtctaccccatctgggcactcctcaccatacttttttaggtgccggtgattgaatttgattgttaagtgtgaatgaaatctgttgtgttctgtaatcattcatttgttagatgttgatgtcaaatactcggtcattgtttgatgtatcacatttgttatttagtttgcatgtgtaaaaatatggaatcaagtcttattgagacactttttggcttcattaaatgttatgaaagtaagaatgatgaagaggattgacctagtatcttcatagcttcttgtgtgttcgcgcaatatagatgattcgtgttgatccttgtattttctgctgttgcgcattattcaacattttgtttctagt

SEQ ID NO: 641 - DNA, 1352 bp, Medicago sativa
  misc_feature (1330)..(1330): n is a, c, g, or t
attcggcaccaggctggatgcttttattatcttcttgccgcgcgttatcatgrkccagaaaagacgtggattggcgaatcaatgaaagatttccttcagcagtccttgtggacaagatatgttacgactatttactggtccatcactactttaacaacagttggttatggagatttgcatccggtgaatgaaagagagatgatctttgtcatattttacatgctctttaatctaggattaacagcatatctgattggtaacatgactaacttagttgtccatggcacaagtcgaactagaaaatttagggataccatacaagctgcatcaagttttgctcacaggaaccaattacctcctcgtttacaagatcaaatgcttgctcacttgtgtttgaagtttagaacagactcggagggcttgcagcaacaggagacactcgagtctcttcctaaagccatcagatcaagcatttcacattatcttttctattctctgatggataaggtttacttattcaagggggtttcaaatgacttgctctttcaattggtatctgagatgaagccagagtattttccacctaaagaagatgttatcttacaaaatgaagctccaactgatttttacattctagtgactggtgctgtggacttggtagttctcaaaggcggggttgaacagattgttggtgaggcgaaaacaggagaactttgtggcgagattggtgtactttgctataagccgcaacattttacagttagaaccaaacgattaagtcaactgttgaggctgaaccgtaccaccttcttgaatattgttcaagctaatgttggcgacggaaccataatcatgaataatcttcttcagcatttgaaagagctgaacgatccaattatggagggagttttggtagagacggagaacatgttagctcgcggtaggatggacttaccagtaagtctatgctttgcagcagaaagaggagatgatttgttgttacaacaattgttaaaacgaggtttggaaccaaacgaatccgacaataatggaaggacagctttgcatatagcagcatgtaaaggaaaagaaaactgtgttttacttctgttagattatggggcaaatcctaacattagagattcggatggaaatgtagcactgtgggaggctatacttggaggacatgaatcagtaacaaaacttttagcagaaaatggtgcaaccttgcaaattggggatgttggtcaatatgcatgcactgcagttgaacaaaacaatttcaatttattgcaagacattatgcgttacggaggagacatcacgcttnccaaataacaatgttggaacca

SEQ ID NO: 642 - DNA, 849 bp, Medicago sativa
ggctactccaatacttcctccaattcccaccaaattccaattgcaatttcaccgattctctctgtagaaactcagtgatacgcttacctcagaatgagttttcaagacttagaatccggccggcgaaacctaatcaacggcaaacaaaacccgacgcaagcggttgcttccggcgtatttcagatcaacaccgccgtctccacttttcagagactcgttaacactctcggaactcctaaagacacgcccgaactccgagagaaactgcacaagacgagacttcatattggacaattggtgaaggatacttcggataaacttaaacaagctagtgaaattgatcatcatgctgatgttaatgcaaccaagaagatagcagatgctaaattggcgaaagattttcaggcagtgttgaaagaatttcagaaggcacaacgtcttgcagctgagagggagacagcttacactccatttgttccgcatgaagatcagccatccaggcagtgaagtaggtgttagttccgataaaagtcaagaacggcatgcctttcttttggaatccagaagacaggaggtaatatccttagataatgagatttccttcaatgaggctatcatcgaggaaagagaacaaggcattcaagaaatccagcagcagataggtgaagtaaatgagatcttcaaagatcttgctgtgcttgttcatgagcaaggagcaatgattgatgatattgggtccmacattgagaattctcatgaagccactgcccargcgaaatcgcaacttgttcaagcttcaaagacacaaagatcaagttcatctttggcgtgcttgcttatggtgatatt

SEQ ID NO: 643 - DNA, 1214 bp, Cucumis melo
aaggaagatgctcatagacggtgaacagtgccaccaggctgaagcggaggaacactacgactttgatttattcgttattggagcagggagtggtggtgttcgtgctagtagattttcagctagtcatggagcaaaggttggcatctgtgaacttccattcgatccaatcagctcagaagtagttggaggaattggyggaacgtgtgtcattcgtggctgtgttcccaaaaagattctagtctatggggcatcgtttggtcctgagcttcaggatgctcgaagttttggttgggatgtgaatgagaaagtggattttgattggaagaaacttctacaaaagaagacagatgagatagtccgattaaatggaatttacaagcgtttactgactaattcgggagtaaaaatgtatgaaggagagggaaagattgtaggtccacacgaagttgaggtgacacaacttgatggtaccaaaatatgttattcagcaaagcacatactgattgcaactggcagtagagcggtcattcctgatattcctgggaaggaatttgggataacatctgatgaggctttgagtttagaggaattgcctaagcgtgttgtggtgcttggaggagggtacattgccgttgaatttgcttcgatctggaatggtatgggtgccaaagttgacctatgttttagaagggaacttccactgagaggtttcgatgatgaaatgagagcagtggttgcaaggaacctggaagccagaggaattaatatgcacccaagaacaaatttgacagaattgataaaaacagggaacggaataaaagttatcacagatcatggcgaggagttgttggcagatgctgtgttgtttgcgactggtcgtgctcctaattcaaaaagattaaatttgaatgcagttggtgtcgaagttgataaacatggtgctgtgaaggttgatgagtattcacgaacgactgtacctagtatatgggctattggagatgttactaatcgaatgaatcttacacctgtggctctaatggagggatcgtactttgctaacactgtttttggtggtgaacctaccaaaccagactacaattttgtgccctatgctgtattctgcataccgcctctctctgttgtgggccaaagtgaagaagaagctgtagagaaagcgaagggtgacattctggtgtacacgtcttcgttcaatc

SEQ ID NO: 644 - DNA, 953 bp, Cucumis melo
acgatttttctcttccttcggccttccaaattcgcacacagatcatcaatcagtttgaaattaaacttctgagtatttgaagggtcgaggcgacgaggaaacaatttagagatgactactgcagctcgacccacatgggcacccgctaaaggtggaaacgagcaaggtggtactcgaattttcggcccatcgcagaaatattcgtccagagacatcgcttctcatacgaccttgaaacccagaaaggaaggacaagatacccatgacgaattgcagaggaggaatctcagggatgagttagaagatcgtgaaaggaggcatttttcatcaaaaaacaagtcatatgatgatagagatcatagaaaaggaagccaacttctgttagaaggtggaaagagagatattgaagatcgtattataccacgaagtttagacgctgatgattctgatgtggatgtcaaaagtgatgatgagagtgatgatgacgacgatgatgatgaggatgatactgaagctcttttggctgagctggaacaaataaagaaggaaagagcagaggaaaagcttcggaaggaaagacaagagcgggaggaagagcttaaagtcaaggaagcagaattactccgaggaaatccactgcttaatgagcagccctcctcttttagcgtcaaaagaagatgggatgatgatgttgtgttcaagaatcaggctcgtggcgaatcaaagacacctaagcgcttcataaatgatacaattaggaatgacttccaccgaaaattcttgcagaagtacatgaagtaacatggtyatcaaagatgaacacatatgtatgataatgcattgaacagactaaatatcacttgaatgttttagtttgtcttctgaattggatgaagtacaagggattggacgaatgaatattaaaacggtttcataagaacctgtcttatctc

SEQ ID NO: 645 - DNA, 1516 bp, Cucumis melo
ttcttctctctcctccatcatcatcatcatcatcgccatcgtcggcctcttcctctctctaaaaagttgaattcctttacctctttcattgcgaattccctcaaaggccaatcttcgaattgccctaattcgccacttttccccatttgaggattcttctgatcctccgctacacgatccccttcatcatttcttccccgatcctcttttccagggaagactcttctgttatttctttttttttctttcttatttctcttgaattttgctttgttttcaatcgatttgttcggagaaaaaggttaggatatcggcgacatgagctttcaagatatcgaggctggtcgcccctttgcttcttcgaggagagacctcatcaatggcaaacaagatcctacgcaagctgttgcttccggtatatttcagattaatactgccgttgctacgtttcaaaggcttgttaataccttaggtacaccaaaggatacgcctgagctacgcgagaagctgcacaagacaaggttacatattggacagttggttaaagacacttctgctaaacttaaacaagccagcgatatagatcatcatgctgaagtgaatgccagcaagaaaattgcagatgctaaacttgcgaaagattttcaagcagtgttgaaagagtttcagaaggctcaacgacttgcagccgagagggaaacagcatattcaccttttgttccccaaactaatctaccttctagctacacagctggggaggcagatgcaagctcagaaaagaatcttgaacagcgtgcccttcttgtggaatccaggaggcaagaggtcttgctgttggayaatgaaatagccttcaatgaggcaataattgaggaaagagagcaaggcattcatgaaatccagcagcaaattggagaagtgaatgaaatttttaaagatcttgcagttctagttcatgaacagggagcaatgaytgatgatattggatccaacatagagggggcacatgctgcaacgtcacagggaacaactcaacttgtaaaagcttcaaagacacaaagatcgaattcatctctggcttgcttacttttggtgatatttggtattatcctcctcattgtgatcataatagtcgttgcttaaaagaaagaagtatgcattgacttgactcaagaaacttgctgctgttgtagcaaacgtcaaatctctctctctctctctctcctgttagtttcttttgattaagttttacaattgtgtcttgagatccttgcattcttggaaaagggatgcggttgtgaaggggctctatgtatactatgtcgagaacccgccttcaaagtatacacatcgcttctatyaggtcgaccatttctcttccgtttgaaaatgttataacctctgtttgtgtgaaagggtgtgtacaacctgcttgtttcttctttttatttttatttttattttttttccctatttttaattattcaattatattgataaattatttttcttctcc

SEQ ID NO: 646 - DNA, 812 bp, Cucumis melo
acctcagaatttgtttgtattgacttccttgactcgcttcactaatggrkgagtttactcctaataccaatctccactttcttccttcgatcaagcttttcctttcacttctactcatcaattccatcttcactttccacactgctctctctgaaattttcttcgaagagcgattcgaagatggatggaagagccgttgggtcttatctgactggaaaagaagtgaagggaaagcagggacttttaagcacaccgccggaaaatgggctggagatccagatgacaaaggcattcagacttacaatgatgctaagcattttgccatatctgcaaagataccggagttctccaacgagaacagaactctagtggtccagtattctatcaaattcgaacagragattgaatgyggtggcgggtaccttaagcttcattctggttatgtcaatcagaagaaatatggtggcgataccccttacagtatgatgtttgggccagatttatgtggtacacagacgaaaaaactccatgcgatcctttctttccaggggcagaattatcccataaagaaggatttgcaatgtgaaacagacaagttaactcatttctacacattcattcttaggcccgatgctagttacagtatacttgttgataatcgagaaagagattctggaagcatgtacagtgattgggacatcctgccacctaggaaaatcaaagatgttaaggcgaaaaagcctgctgactgggatgacagagaatacattgaagatcctaatgatgttaaaccagagggatatgattcaatc

SEQ ID NO: 647 - DNA, 429 bp, Nicotiana benthamiana
cagtatatacaccttttgttccccaagcagttcttccttctagttatacagccagtgagatagatgtttctacggaaaagagtccagaacagcgaactcttcttgtggaatctagaagacaggaggttttgctattggacagtgagattgcttttaatgaagcaattatcgaagaaagagagcagggaatacaagaaatacaacaacaaattggtgaagtgaatgaaattttcaaggaccttgctgtgcttgttcacgagcaaggagctatgattgatgatattggctccaatgttgagaatgctcatgctgcaactgcacaggggagatcgctacttgctaaagctgcaaagacccaaagatcaaattcatctctgacttgtttgctcctagtgattttcggaatcgtgctcctcattgtgattatag

SEQ ID NO: 648 - DNA, 626 bp, Avena sativa
cggcacgaggggatgaggataagatagttccacgggaaatagatgcagatgactctgatgtggagcccagaagtgacgatgaaagtgacgacgatgatgacgatgatgacactgaggctctaatggcagagctcgaaaggattaaaaaagaaagagctgargataarctwagaaaggaccgscagcaagcagaagaagaggccaagatgaaggaggctgagctgatgcgaggaaacccgctgatcaatatgaataactctggctctttcaatgtgaagagaaggtgggaygatgatgttgtattcaagaaycaggctcgtggagagaccaagacaccraaacggttcatcaatgacaccatcaggagtgatttccaccgyaagtttctgcataggtacatgaartgatgctgctgtatgctttatgytstctggacgtgtatgtcatgacctcctggaaaragcttgtkatgtttctgtattctgaagatcgatatgtatgamataactgtaacatttgcttatctgaatsgwgatattttaccmtgagtaaagaaacccactgcttgtgtataactgatgctgtgtcgtaacttctgtcgttattattatttagtatttgaattc

SEQ ID NO: 649 - DNA, 1182 bp, Avena sativa
acactagaaatacccacaaaacatactaatagcagcacagatctcgtatagcatacatgtatttgagaggttccataccattcccatctaagmgrcataccattcccatctaagcgacacaatacaagaattgaagggaaagaatgctcatgtgacaggttagcctaatcatatgaaggattaagggctaatactcactgttccatgatcccaagcgaacaaatcgtrcaaacaaatacgacgcaattggacagcaaccagagccaacaggtgggagcagtttatgaacctgtccagggcgagcacacaaaattcataaagcatcatatgacaaggggtagcactggcatcaagtggtggcgaagatggcttaaaagtgcggaccatatggacttggcggagacaggcacaccatccatatgtatcatcctattccttgtacttcatgctatcgagcgtgaagccaggcatgtcaaaggaggtggcaaacttctcgacctcgcccttgaggttctcgatgtctttgttcgaagatcaatttgaaaggtcagacgaatttcataagcagttaataattaaagttcgtgaaattttgacggacaaagaatggcgccggagaaaaatgcagatgaggatatcggaggaagaaggaagattgaagaaggacgaggaggaaacaaaagaaatgtggaagagaaagagagagcatgaagagaagtgggaagagaccagagacaaacgagtctctagctggagggatttcatgaagaccggaaagaaggcacggaaaggagaactcaaacctccaaggcttaagactgaagatccgaacaaatcttatgttcagagaccagtgaagcgtggttaagaagaatggtgagaacaatcttgtggccattcttctcacgacctggtcccagctacagcctagcaaggttatatttcgggctgtaagtttgagttatggtcttctctgtcccaggtgtagtcagaggaacagaacagataatgcagaagcaaaaatggccatatatcaccyacctwgagtggtayttggactartgtacttgtggagtagaataccttcatgaaaattgttacagatttctgttggaaaagawactcactgaygtgtatcttgaaatatatcctttgtttcacttaaaaaaaaacctcgtgccg

SEQ ID NO: 650 - DNA, 1162 bp, Allium cepa
gtttctgaatcttctttccaatattaaccatcgttcccaatttcatttcttcttttaaacgaagggcataataattcctcggaaatgagtttccaagatctggaagcggggcggccgttaaagggtcggatcaacggaaagcaggatccgacccaagccgtcgcttccggccttttccagatcagcaccgccgtcgccacgtttcagcgcctcgttaatacgctcggaacgcctaaggatacgcctattctccgagagaagctacgtaagacaagattgcatatcactcaactggtgaaagatacatctgctaagctcaagcaagctagtgaaacagatcaccacattgaagttagcgcaagtaaaaagattgctgatgcaaagctcgctaaagactttgaagcagttttgaaagaatttcaaaaagcacaacgacttgctgcagagagggaaacagcatatgcacctttcgttccccaagcagctcagccgaacagcaatacttcaaatgaagctgatgttagttatgataaatctcaagagcagcgtcaactgttggattccagaaggcaagaggttctcctgttagataatgaaatcgtcttcaatgaagccattattgaagagagagaacaagggatacaagagattcaaaaccagattggcgaagtgaacgaaattttcaaagatcttgctgtactggtacatgatcaaggagccatgattgatgacattgacacccatatcgagagttctttagcagcaacagttcaagcaaaaagtcaacttgttaaggctgccaaaacacagaagtcaattcatctttgacttgttkgcttttggtgatcttcggagtggttctactcattgttatcatagtactcgcagcataaccttggttgcaaaaacatcttcttccttcaacccaaggccgtagtggagctgaaagaagtgggtatcatctcactttatatggctatgtcagtatataaaagagtgttacatatcttcttgtaccttgtgttattaatatttactctcatgtttgtaaatttctactttttttcctgtgttttgactttcaagtgcttgttgcgtgtttgtgtgggttttcgcaaagctttgagatgccaggtgctaaatttgctgttaactctgtaat

SEQ ID NO: 651 - DNA, 717 bp, Allium cepa
ctttagttgtgaaccctaaatttaaaatccaggctatccccatcaatttgaaacatgacaaccgcagcgagaccgacgtgggccccagcaaaaggagggcaagagcaaggcggcactagaatattcggtccttctcaaaagtactcctcaagagatcttgctgctcacacgactctcaaacccaggaaagaagggcaagatacccaagaagaggtacaaaggaggaatctccgagaggaattggaagagcgtgaatataggcatttctcgtcaaaggataaatcatttacagaggacagagatcgaagaaaagggcatcttcttctagaaggttcaaaaagagatgtagaagaccgaattgtccctcgcaatgttgacgccgatgattcagatgtggatgtcaaaagcgacgatgacagcgatgaagacgacgacgacgatgaagatgacactgaagctattatggctgaacttgaaaggataagaaaagagcgggcagaggagaaacttaggaaggaacgccaacaacaagaggaagatctaaaggtgaaagaggctgaattaatgagagggaacccgctaatcaatatcaacaatgcagcttccttcaatgttaagagaagatgggacgatgatgttgtctttaaaaacaaaactcgtgggtgaagtgaaggctcccaaaagattcatcaatgataccatcagaagtgatttcca

SEQ ID NO: 652 - DNA, 1301 bp, Allium cepa
atcagaaagtaatatcaaatggatgatgatttcgatatgccaacaggcgaggatatgatgaacgaagatatgatggattgaagaagaagcttgttaaggaaggcgatggatgggagactcctgaagcaggcgacgaagttgaggtgcattatactggaactttgcttgatgggacaaagtttgattcaagtagggatcgtggaactcctttcaaattcaagcttggtgaaggccaagtaataaagggatgggaccaaggaattaaaaccatgaagaaaggagagaatgctgtttttactattccacctgaacttgcttatggagagtctggttctcctcccacmattcctcctaacgctacgcttcaatttgatgttgagcttctttcatggtcaagtgtcaaggacatttgcaaggatggtggaattataaagaagattcttaaggagggtgaaaattggcagaacccaaaagaccgtgatgaagtttttgttaagtatgaagctagactcgaggatggcacagttgtatccaaatccgtgggagttgaatttaccgtcaaagatggattattttgtcctgcactagctaaagctgtgaaaacgatgaaaaagggtgagaaggttattctgacggtgaaaccacaatatggattaggtgaaatgggcaggcctagttctggtgaagagggtgctgttcctcctaatgcaactttgaacattgagcttgaacttgtttcttggaagacggtttctgaaatcggagacgacaagaaaattttgaagaaaatcctcaaggaaggcgagggatatgataagccaawkgaaggagcggttgttaaagtgaaattaagtggaaagctgcgagatgggaccatttttgtcaagaagggtaatgatgaggagccatttgaatggaagacagacgaagagcaagtaatcgaaggactggataaggctgttatgtccatgaagaaaggtgaagtggcctttcttacgattccaccagaacatgctttttcgtcaactgaatcaaagcaggacctagctgtggttcctccgaactcaattgtcacttatgagattgagttggtatcgtttgagaaggaaaaagagccatgggacatgaatacgacagagaaaattgaagcttgctggtagaaagaaggaagaagggaacacgttgttcaagcaaggcaaatatgtgagggcctctaagagatatgagaagggtgccaagttcgtagaacatgatagctcattcagtgaaatgaaaagaacagtccaggcattaaaaggttg

SEQ ID NO: 653 - DNA, 1249 bp, Carica papaya
aggttattctgacagtgaagccacaatatggttttggggaaaagggaaagccggcctctggcgatgaaggtgctgttccaccaaatgcaacacttcaaatcactctggagctggtttcatggaagactgtgtcagaagtaacagatgacaagaaagttatcaagaagattctaaaggaaggtgaaggatatgagcgtcctaatgagggagctgtagttaaagtgaagttgatggggaaactgcaagatggtactgtgttcttgaagaaaggccatgatgaagatgagttgtttgagttcaaaacagaagaggagcaagtcattgacgggcttgatagagctgttgtgacaatgaagaagggtgaggtcgcattattgaccattgcaccagaatatgcatttgggtcctctgagtcaaagcaggagttggctgttgtgccaccaaactcaactattaactacgaggttgagctggtgtcctttgtcaaggacaaggaatcctgggacatgaacacccaagaaaagattgaggcagttggcaaaaagaaggaagaagggaatgtattgttcaaggcaggaaaatatgcaagagcttccaagagatatgagaaggctgtcaaatacattgagtatgatacttccttcggagaagaagagaaaaagcagtccaaagcattgaaggttgcttgcaatttaaacaatgcagcttgcaagttgaaattgaaagattacaagcaggcagagaagctgtgcacaaaggtgttggaactagagagtagaaatgtgaaagctttgtacagaagagcccaggccaatattcagctggctgacttggatttggccgagctggatattaagaaggctcttgaaattgatcctgacaacagggaggtcaagctggagtatagaactttgaaggagaagatgaaggagtacaataaaaaagaagctaaattttatggaaacatgtttgctaaaatgaataagttggagtctcttgaatcaaataaaacaacttcaaaggaagcgaaaccaatgagcattgacagcaaggcttagttaataaccgagcctctaactttggctggaaaatatacaaggtcactcagtattttttttttatttggggggtgctaaagcacgtactttccatggttttaattgcttcagatctgctttcatttgtaggaccgctaaattgttgtagtctggagttttctttttcttgtgcggattgttggcttaatata

SEQ ID NO: 654 - DNA, 827 bp, Carica papaya
gcagtagtgctattaatagagtggacatggacactgactgcttggattatgaaatcttgtgggaggacttgactattggagaacaaattggacaaggttcttgtggaactgtatatcatggtctgtggtttggatcagacgttgctgttaaagtattctccaaacaagagtattcagatgatgtgatagattcctttcgacaagaggtgttgctgatgaaaagacttcgacatccaaatgttctgctctttatgggagctgtgacttctcctgaacatctctgtattgtcacagagtttctgccacgaggaagtttatttcggttactgcataggaacacacccaaactagattggcgacggcgtatccatattgccttggatatagcacgaggcgtgaattatcttcatcattgcaatcctcctataatccatcgtgatttgaagtcatcaaatctgctagttgataagaattggactgtgaaggttggtgattttggtctttcacgtctcaagcacgaaacatatctcaccaccaagactgggaaggggacgcctcaatggatggcaccagaagttcttcgtaatgaaccctcggatgagaaatctgatgtgtatagctatggagtgattttatgggagcttgcaactgagaaaatcccatgggataatctcaattcaatgcaggtgattggggctgtagggttcatgaaccagcggctagaaattcccaaggaagtggattcacagtgggcttctataattgagagctgctggcacagcgatccacagtttcgtccgacattccaagaacttctcgaaaagctt

SEQ ID NO: 655 - DNA, 1245 bp, Carica papaya
aggcgactgttactcgccttcacccatcctctcagggtttgaaggagttcatcaatgaggttaacacacttgcatctctgcaacatccaaacctatgtaagttgctaggttatcatgcacgagatagttcagagcaaagaatgctgatctatgagaggctgtttcatgggagcttggaccgcttactatatgggagatcagatgggccactcgttgattggaacaccagaatgaagattgctttatgcgctgcacaaggtcttactttcttgcatgaggaaggacctttccaggcaatgtacaatgaattttcaactgccaacatacaaattgataaggattttagtgcaaagctttcaggttatggttgtgtgggtcatattccagaagcagagatctctaatagttcagttgctttagcaaacctttcagttgaaacgttagaaagaggactgctgactccaaagagtaatgtgtggagcttcgggattgttcttcttgaactacttactgggaagaagaatcttgacagtcgtcatcccaaggaagaatggaacttggttaaatggagtaagcctttcctggctgatgattgccgactatctctcatcatggatcctcttctgaaaggccgctttccagccaaagcagcacgtgcagtagctgacattgcccaaagatgtcttcaaaaagatccatcagaaaggccgaccatgagaacaattgttgaacgtctcaaattcatacaagatatgaaatactcctgccggttccccctgcaagagcctgcacttatttctggaaaacagatgtcaagatctcctagtcttaacggaatagtgaccccagcaccaaggttaagtttctctccatctccaccatcaagaagtcgaccgtctgtttctcctccaagacctcatggactgccgttgtcactcccaccacgagcttgttcatcagttctttcacttgaggaacttgagaggcaagaaagtcaaaaatcatcttcgacagttcggaggccaagtgttgaaggattttgattgttaatatatgcattttttttttcttaaatttttttattttggaattcaacacagcatataggagatgagttgttgttcttcaacctttgctgatcctcaggatgattaaatagagaggatggtgttttgtagataaatttaaagaactcgattaatcttctctgatctagaaatgcacagtacatagaaattttactct

SEQ ID NO: 656 - DNA, 1088 bp, Carica papaya
ggaagaatgagaatgagaagatagaggagcttgtgagggagtattcggcttcgactgatttggtgagcttggactggaagaaaatgaagatacctccagttttatcttccactgaacatgcttggttgttcaagttgatgcagcctatgaaggcactccttcaagtgaaagaggaattggagaagaatctcggacatgagccaactgaaggtgaattagccaaggcaacgaatatgaatattgttcaagttaaaaaacagatggagattggtagagctgcaagaaacaagctcattaagcacaatctccggctcgtgttgttcgtaatcaatagatactttcaagactttgcaaatggatcaagattccaagacctctgtcaggctggagttaaaggtcttattacggcaattgatcgttttgaaccaaagaggagattccggctttccacctacagtttgttttggattaggcatgccattatacgttccatgactgtctcgagctttacccgcgtctcgtttggacttgaatcggttagagtagaaattcagaaagccaaactcgagttgttgtttgagcttggaagattaccaaccgatgatgagatcataaaaaaagttggaatttccccggaaaggtaccacgaagtaatgagagcttcgaaaccagttttttctctccattcgaggcatgctgtcacacaagaagagttcattaatgggattacagatgttgatggtgtcggaagtgatagtcagaggcaatctgctcttcttaggctggctctggacgacgtgcttgattctctgaagcctaaagagagcttggtaataagacaaagatatggtcttgacggaagaggtgaccggacgttgggagaaatcgcgggaaacctaaatatttcaagagagatggtaaggaagcatgaagttaaggctttcatgaagctcaagcatccaactcgagtggattatctttgccgatatattgtctgaaaaaccaaacaggaccttatcccatgcttgtcatttgtttataatcattttgattttgattagatgaacaaaattctcatacaccatgta

SEQ ID NO: 657 - DNA, 912 bp, Carica papaya
ctcctggatcgtggctcggcagcaatcatattctccattctcttgagaaccctaggctagtgtcttgttgctggtctctagctttctcacaggcgtagttctgttggttctctaggcatggcgagaaaaatgcttattgatggggagctgaacaaaccaagcgaagaggctcactacgattttgatttgtttgtaattggagctggaagtggtggtgttcgtgcagctaggttttcagcaaattttggagctaaagttggtatttgtgaactaccttttcatccaatcagttcagaagtaattggaggagttggtggaacgtgtgtaattcgtggttgtgttccaaagaagattttggtgtatggagcatcttttcgaggtgaaattgaggatgccaggaattatgggtgggaagtgaatgagaatgttgacttcaactggaaaaagcttttgcaaaagaagacagatgaaatagtaagactaaatggaatttacaagcgtttattgtcaaatgctggagttaaattgtatgaaggtgagggaaagatagttggtcctactgaagttgaggtaacacaattagatggcactaagttgtgctattcggcaaagcacatattgattgctactggcagtagggctcagcggcctcctattcctgggcatgagttggctataacctctgatgaggcattgagcttggatgagttgcctaagcgtgccgtagtgcttggaggagggtacattgctgttgagtttgcttcaatatggcgtggttttggatctaatgtggatatatttttcaggaaggaactgccattaagaggttttgatgatgaaatgagagctatggttgcaagaaatttggaaggaagaggaattaatgtgcaccccaggacaagtttgaaagaa

SEQ ID NO: 658 - DNA, 1012 bp, Carica papaya
gaaggaaggtgaaggctgggagacgccaagcgcgggcgacgaagtcgaagtgcattacactggaaccttacttgacggaaccaagttcgattcaagccgggataggggggcacctttcaaattcaagcttggtcaaggacaagtgattaaaggttgggatgaaggtatcaaaactatgaagaaaggggagaaggctattttcaccataccaccagagttggcttatggagattctggttcccctccatccattcctcccaaggcgactctgcaatttgatgtggagttgttgtcttggactaatgttaaggacatctgcaaggatggaggaatattcaagaaaatacttgtggaaggagagaaatgggataatcctaaagatttggatgaagtattagttcggtatgaagcacgtcttgaagatggaacacttgtttcgaaatcggatggagtggaattcactgttgcagaaggctatttctgtcctgcactggagaaggccgttaaaacgatgaagaaaggcgagaaagtattgctgacagtgaagcctcagtatgcatttggcgaaaatggtagaccagcatcaggtggcgaaggggccgtacctcctaatgcgaacctggaaataactttggagttagtctcttggaagactgtaactgatgttaccaaggacaagaaggtcctaaagaaggttttgaaggaaggagaaggatatgaacggccaaatgaaggagcagttgttcaagtgaagctaactgggaagctgcatgatggcactgtctttgtgaagaagggctacgatgaagagccgccatttgagttcaagatagacgaagagcaagttattgatggactggacagggctgtgaggaacatgaagaaaggtgaagttgcacttatcactatccacccagagcatgcttttggtgctacagggtctcagcagatttggctactatccctcccgactctacggtatattatgaagttgaaatgatatcctttgtca

SEQ ID NO: 659 - DNA, 2122 bp, Prunus persica
atccaattctgtaaacactagaatacaagaatgtaaatgtggaacatcgtaattataaaaggaaaggcaaactcgtctgctacttcctttcttctatacaaaagccagcaaccatttatattcattgctccaatccaaactcaattaattttcagatggatcatcccatctccgatgaccccaaatccccacttctccctctccaccacgatcacgatcacgatcacgatccaatccaacggtcacaaagcttcctgtcaggtttgaaatccattctaacactcaagaccttgtccgtcctcctaggacctcttctgtgcactattatatgcctctgtgtgaagctagatggccctgtggctagccggaacatgctggcagtgcttgtttgggtctttgcttggtggctcacagaggctgtgcctatgcccatcacctccatgtctccgctctttctcttcccgctctttggaattgcctctgctgatgatgtcgctcactcttacatggatgatgtcattgcgcttgttcttggaagcttcatcctggctcttgctgttgagcattataacatacacagaagattggccttgaacataaccatgctattctgcggagatccactgaatcccccgctgctcctgctggggatatgcgccacgacagctttcgtcagcatgtggatgcacaacgtggcagcagctgtgataatgatgccggttgccaccgggatcctccagcgctttccagtgggtcccgaccagtccgtcgctgtgagcaagtactgcagggctgtggttctgggagtgatatactccacagccataggagggatgagcactctcacggggacaggtgtcaatctcatattggttggaatgtggaagagctattttccagatgcagagcccatcagcttcagcacctggttcttttttgggttccctctggccttgctcatgttcttggctttgtgggttatactttgttgcttgtattgctcaaggaattcaagccaggctctctctggttatttggacaaggcccatttgaagagggagcttgaaatgttaggtccaatggtttttgctgagaagatgatattggctgtgttttcgatgctgatagttttgtggatgacaagaagcataacagatgacattcctgggtggggagccctcttcaaagggcgtgctggtgatggaacagtcagtgtcatgatggcaactttgctgttcataattccgaacaaaaagcaaaagggagagaagttgatggactggaacaaatgcaagaagctaccttggaacatcatattgttactaggagctggttttgccattgccgacggagttcgaaccagtggccttgcagacattttatcaaaagccttagatttcttggaggcagttccatattttgccattgcgcctgccgtctgtctcataagtagcaccatcactgagtttacatcaaacaactccaccaccacgctggttgtgcctcttctaattcaaatagccaaaatcatgcatgtaaatccactcctccttatggttcctggagccattggggcacaattttctttcttgcttccaacaggaacaccttcaaatgtagttggatttaccactggccacattgaaatccaagatatgatcaaaaccgggttgccattaaagattgctggaattgctgtgctctcccttttgatgcctacacttggagcatatgtatttgggactaacggaccagttcaatgacttgaaaattcgaaatattttcatgtcttgtgaaatctcaagctcagggcataagaaaaatattgtgtgtgtgtgtatgtatatatagtcacactcacaagcacaaaaatacttctcttctctcacaattttcccctgcttcttttttgcattccttcgttggtaggtagagcttggtatgtacatctatgattgcagccatttgcaattatatatagttttcaattctgtgtatctcattatttctctgatctgtatgtgttgtataaaagtttcttaggagaatgctatatttgcttttcctacaaacattacttgcagttatgctcaagtgtataatgtgagtggcgcgtaaaaaa

SEQ ID NO: 660 - DNA, 1592 bp, Prunus persica
atgcccttttcaccatccctcctgagctggcttatggagagactggatccccaccaactatccctcccaaagccacattgcagttcgatgttgaattgctatcttggaccagtgtcaatgacatatccaaggatggtggaataattaagaagatcttgaaagagggagaaaaatgggagaacccaaaagaccttgacgaagttatagttaactttgaggctcggcttgatgatggaaaagttgttgaaaaatctgacagagtggaattcactgtcaaagatggttacttctgtcctgcgctatcaaaggctgttaaaacaatgaagaaaggggagaaggtattattaacggtgaaaccacaatatggatttggggataagggtaagcctgcatctggttatgtgggtgccgttcctccaaatgccactcttcacatcactttagagttggtatcatggaaaactgtctcagaagtgacagatgacaagaaggttattaagaagatcctgaaagaaggggagggatttgaacgtccaaatgaaggggctgttgttaaattgaaattgattgggaagctgcaagatggtacggaatttttgaagaaaggtcatgctgaaggagaagagctgttcgagtttaagacagatgaggaggaagtgattgatgggcttgatagagctgtcctgacaatgaagaagggtgaggtagcactcctgacccttgcaccagagtatgcatttggttcttcagagtccccacaggagttggctgtggtacctcctaattcgacagtctactatgaggttgagctcgtatcttttgaaaaggataaggaatcatgggacatgaataccgaagaaaagattgaagctgctggcaagaagaaggaagaagggaatgcactgtttaaggcgggtaaatatgcaagagcttccaagagatatgaaaaggctgtcaagtacattgattatgatacttcctttagtgaagaggacaaaaaacagtctaaggtgttgaaggttgcttgcaatcttaacaatgcagcttgcaagctgaagctgaaagattataaacaggctgaaaagttgtgttccaaggtgttggaaatcgagggtagaaatgtgaaggccctgtacagaagggctcaggcatatattcagctggcggatttggatctggctgagcttgacatcaagaaggctcttgaaatagaccccaacaacagggatgtgaagttggagtacaagactttgaaggagaagatgaaagaattcaawaaaaaggaggccaagttttacggcaacatgtttgccaaattgaccaagtcggactcgccggattccaataaaacagcagctaaagatgctgaacccatgagcgtagacagcaaggcgtaaggggactgcatcacataatcggctcgcagcttctaattgtgtcattaaggagtaaattcctagtttttttaaattgtgtaggactacttggtcttggcgcaaggaagttgtaatggatgatttactaaaactggattgtaagcattgaattttataagttaaatatttttcaatataccaaaggtatgttgcttt

SEQ ID NO: 661 - DNA, 1058 bp, Prunus persica
  misc_feature (829)..(829): n is a, c, g, or t
  misc_feature (891)..(891): n is a, c, g, or t
  misc_feature (1034)..(1034): n is a, c, g, or t
tacaaattgctttccagcacgaaaacaaaaaacaaaaaacaatttacaaattgctaacgtttctctctgctcgaatcaaatcgaagaacaaattcaagaaggttttgtgaatataatttgaagacatgacgactgcggctcgacccacgtgggcacctgcaaaaggtggtaatgaacaaggtggtactcggatttttggcccttctcagaaatactcttcaagggacatggcggcccatacaactctaaaacccagaaaggaggggcaagatacccaggacgagttgcagaagaagaacctccgagaggagctggaagagcgtgagaggaagcattattcatcaaaggataaatcgtatagttatgacagagatcgcaggagaggaagccagctgttgctggaagggggcagaagggacactgaaattgtgccgcgtaatgtagatgctgatgattctgatgtggaagtcaaaagtgatgatgaaagttctgaagatgatgatgatgatgatgaagaagctctgatggccgagcttgaacaaattaggaaggaaaaagcagaggagaagctacgaaaggaacgacaagagcgggaggaagagcttaaagtcaaggaagcagagcttctccgagggaacccattgcttaatggtgcaacagccacatcctttagtgtgaaagaagatgggagatgatgtgtgtttaaaaatcaggcccgtggtgaaaccaaggctccaaagcgcttcatcaatgacacagtcaggaatgactttcaccgcaaattcctgcataaatacatgaagtaatgtcataaatcaatctatatctngagatgggacccccccagcaacaaagtcaaaatgaactttgtctttgacagttgtatgtacngtaatgttgcaattgaatgcaccgtgcttgattcaaattgtcttgtactgaaagaaaaagaaaaggggtgttgaagatgtaaggcatgtaagctggatcttgatattgaatgttacctgttttatgtagttggaaggaatagnttgtttgttgaacttggtgatgcg

SEQ ID NO: 662 - DNA, 2080 bp, Prunus persica
agcctataacaaatttctcttccctctctctctgtctctctttctctctctctctctstctctctctctctctctctacgtcggtctgttttgcttctgcagctacctcccatttattttcgcattacgcgcactcgcatttttattttcccattgtttttgttctatatcctaaaaccctacaagccacaacaacagtcgcttcgccatcttcaacttcaagatttagttggatttactctataatcatgtcgaggaagatgcttattgatggtgaggtgagccaacctaatcaaggagaggtccactacgacttcgacttgttcgttattggggctggaagcggcggtgtccgtgcctccagattttccgcaaattttggagctaaggttgggatatgtgagcttccatttcatcctatcagctcagaagtagttggaggagttggtggaacatgtgtcattcgtggttgtgttcccaaaaagatcttggtgtatggagcatcttttggtggtgaaatcgaggatgccaggaattatgggtgggaagtgaatgagaaagttgatttcaactggaagaaacttttgcataagaagacagaggaaataattcgattaaatggaatatacaagcgtttattgtcgaatgctggggttaaattgtttgaaggagaggggaagatagttggtcccaacgaagttgaggtgacacagctagatggcactaaattgagctattcagccaagcacatattgattgcaactggcagtcgggctcaacgacctgctattcctgggcaggaattgggtatatcatctgatgaagcattgagtttggaggagttacctaaacgtgttgtggtgcttggcggagggtacattgctgttgagtttgcttcaatatggcgtgggatgggtgtttcagtggatctattcttcagaaaggaacttccattgagaggttttgatgatgaaatgagggcagcggttgcacggaatctggaaggaaggggaattgatctacacccacagacaaatttgacagagttgataaaaacagaggatggcataaaagttagcacggatcatggtgaagagctgatagcagatgttgtactgtttgccactggtcgagctcccaatacaaagaggttgaatttggaagccgtaggtgtggaacttgataaaacaggagctgtgaaggtagatgagtattcacgtaccaacatacctagcatatgggctgtcggtgatgttacaaaccgagcaaaccttacccctgtggctttaatggagggaacttgcttcgcaaaaactgtttttggtgaccaacctagcaaaccggatcaccgcgatataccctgtgcagtgttttgcattccacctctttctgttgtgggccttagtgaagaacaggcaatagaacaagccaaaggtgatatattggttttcacatcaaccttcactccaatgaagaacactgtatctggacgacaagaaaagacaattatgaagcttcttgttgatgctgagacagataaagttattggggcatccatgtgtgggccagatgcacctgagattgtgcagggcattgctattgcactgaagtgtggggcaaccaaggcacagtttgacagtacggtgggaatacacccttctgcagcagaggaatttgtgacaatgcgttcagtgacgaggcgtattgctgcaggtagcaaaccaaagacaaatctataaggatgcaagcaataggacgaaaagatttgtatacaaggtctggaggagtttgtcctgtcctcccaaagctcacgtagttgtttcacattcaccagaggaggaaacatatatattttgggaaatttaaattggttgaattctgtcacaataagagcttgtagggcagtataagttctaaatgattgatggagatacaatattgatctctacataactgtatcacttgatccatgacagtgttgccgtgctttatatactctgctgatacctgtcaatttagacacttgcacgagtaatttacttcctccctttttataaatacaattaagtttctgcttaag

SEQ ID NO: 663 - DNA, 1377 bp, Prunus persica
ctcgctctctcgtttcccttcctctccgtctctctctctcttccgaatcatcgcctcctgcttgtctccccgttcttcccgcaattcttaattcgtatccaaacaccagcttctctttccatttttttcgaaattctcgtcgggattttctcgggaaagtaagggttagggtttgggagggaagcgagatgagctttcgggatctggaagcaggaaggggcttgggtttttcaaggcgtgacatcgtcaatggcaagcaggacccgacccaagccgtggcctcaggcattttccagatcaacaccgccgtatccacctttcagaggctcgtcaacaccatcggtacccccaaggacacgcccgagctccgcgaaaagctgcacaagacaagactacatattggtcaattggtgaagaatacttcagaaaaacttaaacaagttagtgaaagagatcatcatactgaagtcaatgcgagcaagaagattacagatgctaagcttgcaaaagattttcaagcagtgctgagagaatttcagaaggctcaacggcttgcagctgagagagaaacagcatatgctccttttgttccccaagcagttcttccgtccagctacactgctagtgagatagatataagctcagataagagtcctgaacagcgtgctctccttgtggaatctagaagacaggaggtcgtgctattggacaatgagatttccttcaatgaggctatcatcgaggaaagagaacaaggaatacaagaaatccagcagcaaattggtgaagtgaatgagatttttaaagatcttgctatattggttcatgagcaaggaaccatgattgatgatataggctccaatattgagggtgcccacgctgctactggccaggcaaagtcccaacttgttaaggcctcaaagacccaaagatcaaattcatctctgacttgcttgctcttggtaatatttggaatcgtgcttctcattgtgatagtagtacttgccgcttaatcgttggaacaagtcaagatgtgctctcaggatcccgtatgataatttctctaatgggttttctcttgggatataatgcctaacttgagttttgcgctgtattataagttggtatataggtggtgggtagccttaacaatatatctggttgttttggttggttttggttatgtgggatgtgttttttttcttcttattctgtaagttggtgtttggggcttgtgatggtgttccttatctaataatataaatattgataaatttcataattctttgggttttcattggtgtgcatctgccagatttttatttgtcactcgattagaaaatgtgaatggagttcaacttatgttctaaaaaaaaa

SEQ ID NO: 664 - DNA, 1108 bp, Arachis hypogaea
cagatcttgttagtttggactggaagaaaatgaaaatacctccggttcttccttcttcagagcatacttggttgttcaagttgatgcaacctatgaaggcacttcttcaagtgaaagaggatttacagaaggagctaggaaaaaaacctacagaggctgaattagctgacgcaacaaatatgaacgtttctcaagtgaagaaaactatagaggtcggccgagctgcaagaaacaagctcatcaagcacaacctccggcttgtgttatttgtgatcaacaaatatttttcggattttggcaatagcccacggtttcaagatctgtgtcaggcaggagttaaaggtctcattacatcaattgatcgtttcgagccgaacagaagattccggctatccacctatggattgttttggataagacattccatcattcgttcaatgaccctttcaagcttcacacgtgttccctttggacttgaatcagttagggcagatatccaaagagctaaactggagttgacgtttgagcttcagaggcagccaacagatgaagaaataatggagagagctcaaatctccccagaacgatactatgatgtaatgaaggcatcaaaatccattctttccttaaatgcgcggcattcaaccacacaagaagagtttataaatggtattactgacgatgatggtgtcaacggtgataatagaaggcaacatgctctactaaggcttgctcttgacgatgtgcttgattccctgaagccaaaggagagcttggtgataagacaaagatttggactggatggtaagggagatagaacattgggggaaatagctgggaacttgaacatttctagggaaatggtaagaaagcatgaagtcaaggctctcatgaagctcaagcacccagctcgattggattatcttcgtcgttatgttgtataaaatccattaataatgtattattattattattattattactattattactatgtatatgcctctcgcttcccttacacaaattaaatatttgttatgtctcattagccatacagtagtttgatgtgttaatcaatttgtgtcactggtccacacaaaatcataat

SEQ ID NO: 665 - DNA, 1353 bp, Arachis hypogaea
tcggcattacggccgggaatcagtaatcatcattcttcacatctctctcttctctctctaaatcgggttcggtgctgcacgtttacattcataacatccctaattcaccgaattccgatcggtcttccgagaccggcaacaactttcctctttyaatttcccaattctaaggaaacactcttcaattttctcgagaaaattatttagggttacgcaggcacgcgcgcgcgcaatcctctagagagagagagagagagaaattcaataatatagaatgagctttcaggatatcgaggccggccggccgttcgcttcccgccgaggccayatcaacggcaagcaagatcccacgcaggcggtggctgccggaattttccagatcaacaccgcggtctccaccttccagaggcttgtcaacaccctaggaacccccaaagacacccccgagctccgggagaagctgcacaagacaaggctgcacattggacaattggtgaaggacacgtcagcgaagcttaaacaagctagtgaaattgatcaccaatctaatatcaatgcaaacaagaagatagcagatgctaaactcgcgaaagattttcaggccgtgttgaaagaatttcagaaggcacagcgacttgcggcagagagggaaacagcttacaccccatttgttccacaagcagctccatccagctatacacctaatgaatcagatgctcattctggtaagactccagaacagcgtgcccttcttgtggaatccagaaggcaggaggtcttgtttttagataatgagattgccttcaatgaggctatcattgaagaaagagagcaaggcattcaagaaattcagcagcaaattggtgaagtaaatgaaatttttaaagatcttgctgtgcttgtgcatgaacagggagctatgattgatgatattgggtccaacattgagcattcccatgcaacaactgcacaagcaagatcgcaacttgctaaagcttcaaagactcaaagatcaaattcttctttgacatgcttgcttttggtgatatttggaattgtgcttctaatcgtcatcgttgttctggctgcttagtcaaagattatcagttctgttaacgatcaatgatataaactgagccattgaagtgcagctaggatcttccatgctgatgatctctctgaggtgattttcccctgatcttgtcaatgactgggatttctctcgtctggtttcagttcataatttgacacaagtacatcgtgattttgtctttggggtttgtgttgttgtctgtgttggttttagtggttttatggatgcatcacaacgtacttctcgtctattttctcttt

SEQ ID NO: 666 - DNA, 1666 bp, Capsicum annuum
gcccaattcttctctttcttccattagtcccaaagatatctctcctctctcttcccaaattccccccaaatccccccaaaattctagggttttcatattcaatcctttgttgaattttggatcgstactttctttyagctctctttttgtgtagaagttccgattgttgggttttattgggggtaattttgggggaattcgaatttgtattaagagaaaaagagagagatgagttttcaagatcttgaagcgggtcgaccattggggccccgaaagggctatttgaatgggaaacaagacccgactcaagctgtagcttctggaatattccagattaatactgctgtttccacgtttcaaaggctggtcaatacacttggaactcccaaagatacacctgagctacgtgagaagttgcacaagacgagggtgcacattgggcagttagtgaaagatacatctgcaaaacttaagcaagccagcgaaacagatcatcgcgtcgaagtcagtgctagcaagaaaataacagatgctaaactcgctaaagattttcaagcagtattgaaggagtttcaaaaggctcagaggcttgcagccgagagagagacagcatatacaccttttgttgctcaagcagttcttccttctagttataaagccagtgagatagatgtttctacggaaaagagtcaagaacagcgggctctccttgttgaatcaagaagacaggaggttttacttttggataacgagattgcctttaatgaagcaattatcgaagaaagagaacagggaatacaagaaatacagcaacaaattggtgaagtaaatgaaattttcaaggaccttgctgtgcttgttcatgagcaaggagctatgattgatgatattggttccaatgttgagaatgcccatgctgcgactgcacagggaagagcgcaacttgctaaagctgcaaagacccaaagatcaaattcatctctgacttgcttactcctggtgattttcggaatcgtgctcctcattgtgatcatagtacttgcagcctgagctgaagattactggaatatagagaagggccctgaactctgttcagatgcagaaatgattgcattgatttggaaaaggtgactgttgtgattcgagttatttcagaaggcaccttggagtgtggcttggtcgtcccaatccttggttcttctagtcgtagtataaaagtttagttagggaggcgggagagcaaaggtttctgttcaacttgtaaacctggtgctttggttgcaagatgttttgctaccatgtaatggcgggttctgtcagtaaaaaaattattcttgtttggaggggtaattgcaatttcggtacactcttgaaccagttgacatttgacattcattctttgttgatgctcgtgtgtgtgaagctaccactaatgtaatttgttgatttgtttgtcttgccttggtgggcatatattgttgtatggaggtgtcctgctcctcctttctgctaaagcaacttgattcgcttgtaatttatgacaaaacttgagttcaacagtgtggcctatcggacagtgaagtttgagaagaaccatgaggtatcaggtttaggtttaaatctcaacggacaatgaatagtcgaggtgtgttaaactgatcatacc

SEQ ID NO: 667 - DNA, 674 bp, Capsicum annuum
tttttttaatgatgattagatatgaaagatgggttcttttttcgttttgtgacgcggtctaagaggttcttggagattcaaaaattaagagaaatcaagaaggagtatgacttgaaaacggctatacaactgctcaagcaaacagctagctcaaagtttgttgaaacagctgaagctcattttcggctcaatattgacccaaaatacaacgatcagcagcttagggctactgttaatttgcccaagggaacaggtcaaactgttaaagtagctgttcttacccaaggtgaaaagttcgatgaagcgaaaaatgcaggagctgatatagtgggtggagaggatttgatagaacagataaagggaggatttatggagtttgacaaattgattgcaacaccagatatgatgtctaaggttgctgccgtaggtaggatcctaggacctagaggactcatgcctaacccaaaggctggcactgtcacttcaaatatacctcaggctattgaagaattcaaaaagggtaaagtagaataccgagcagataaaactggaattgttcacttgccatttggaaaagccaatttctcggaagaagatcttatcataaacttcattgcagccgtgaaatcagtagaagcaaacaagccgtcaggtgccaaaggagtttattggaa

SEQ ID NO: 668 - DNA, 1330 bp, Capsicum annuum
attttctcactttcttttcatactccatttattcggatacataaaggagtaccaagaagaaagaaaaaaaaatcagattgatcaaaatggaagaagtgagtaacaaacagatcatacttaagaattatgtaagtggattccctaaagaatcagatatggaattgaaaatcaactcaattaaactgaaagtagcagaaaattccaatagtgttttggtgaaaaatatttatttatcatgtgatccttacatgagacctcgtatgacgaaaactgaaggcagttatactgaatcttttactcctggctctcttattgtggggcttggagtggctaaagttgtggattcagctcatccaaatttcaagaaagacgatttagtttggggaatgactggatgggaagagtatagcatcattacagctccggagactctctttaaaattcataatacagatgtacctctttcctattataccggaatcctagggatgcctggaataacagcttatggaggtttttatgagctgtgctcaccaaagaaaggagaaactgtgtatgtttctgctgcatctggtgctgttggccagctcgttggacaattcgctaagctatgtggttgctatgttgttggaagtgctggaagcaaagaaaaagtggaactgttgaagaacaagtttggttttgatgatgcatttaactataaggaggaacaagatttaactgcagctttgaaaaggtacttccccgatggaatcgatatttactttgagaacgttggaggaaagatgcttgacgcggttcttctcaacatgcgaatccatggacgaattgcagtatgtgggctgatctcacaatacaacctcgagcaaaatgaaggagtccacaacttgttctgcctcatctcaaaacgactccgcatgcaaggatttttggctttcgattactatcccctttaccacaaatttgtcgacatggttactccacatataaaagaagggaaggtgaaatatgtggaagacatagctgaaggaattgaaagtgcaccgggtgctctagtcggcctcttctctggtcgtaatgttggtaaacaactggtgcgtgttgctcatgaataaacttattgagtgtgtttggtacgatggaagttatttcatcgcgtaactaaataccagcaaatgactttcacatatgttactatcaagtatgttgagtttgtactgcagaccaaaagttgttttgagttttgtgattagtaaactctgtgttgcaataaattttgtgttttgcaaatatgtttgcttaaatgttagttgtacatctaaaaaaaaaa

SEQ ID NO: 669 - DNA, 651 bp, Capsicum annuum
aaaaatgagtacattgagaataccagaagtagttccttctccaactgaagactctcaaactcttatgaaatccttcaaagttttgtggttgtgtgtaggactgggaactaatgagaagtcagtgatatcggtgttgggccacagagatgcaagccagaggaagaagatcagagaaacctatcaacaactttacaacaagtcccttatcgatgatatttgttctgaattgtctggtgatttcaggaaagcagtcatgttatggacatacgagccttctgaaagagatgcacggctagcaaatgaagccttaaagtcaagaaagaaaaccatcacccaattgcaagtgatagtagagatagcttgtgcatcatctcctgatcatctggtcgcggtgagacaagcatattgtggccttttcaatcgttcacttgaagaagatatcacagcaaatgtccctatgcctgtacagaagcttctaattggtctagtcaggtcatatagatatgataaagaactggtggatcctgatacggcaaatgcagaagctgctatccttcgtgaagccatacggacaaaacagttggataatgacaattttcttatcatactcaacacaaggaatgttcatcaacttagagcaacttttgagtg

SEQ ID NO: 670 - DNA, 606 bp, Capsicum annuum
gaaaagttttttaaaaaatcattttgattttcctcttgtattttcttgatttagaaaaattgtagtaatgggtgttcaagaaaaagatccacttttgcaattaagtttgccaccagggtttagattttatccgactgatgaagagcttttagttcaatatttgtgtaagaaagttgctggccataattttcctctacaaattattggagaaattgatttgtacaaatttgatccttgggttctacctagtaaggcaatgtttggagaaaaagaatggtacttttttagtccaagagataggaagtatccaaatggatctcgacccaatagagttgccgggtcgggttattggaaagcaacgggtactgataaggttataacatcacaagggagaaaagttggaattaagaaagcgcttgtgttttatgttggtaaagcaccaaaaggatccaagactaattggatcatgcatgaatatagactttttgaaacttcaaggaaaaatggaagctcaaagcaatgaatacagccatgctgcttcttcgacgacttcttcttcatcccaattcgatgatatgctcgaatcattaccagaaatggatgatc

SEQ ID NO: 671 - DNA, 714 bp, Capsicum annuum
caaaatcccaaattctccgatcctctccgattctactatcgctcctccttagattttgtcttgagagctagaagatatgacgacggcagctagacctacgtgggcacctgctaaaggtggcaatgaacaaggtggaactcggatatttggtccatctcaaaaatactcttcaagagatattgcagctcacacaacattaaagcccagaaaggacggacaagacacccaggatgagttgcagaagaggaaccttcgggaagagttggaggaccgtgagcggaggcatttctctaaagataagggttataatgatgacagagatcgtaggaaaggtagtcaactcttattggaaggggctaaacgagaaattgaagatcgtattgttccacggagtgctgatgctgatgatgctgatgtggatgttaagagtgatgatgagagtgatgacgatgatgacgacgaagatgatacagaagctctcttggcagaacttgaacagataaagaaagaaaaggcagaggagaaacttcgtaaagaaaggcaagagcaagaagaagagcttaaggcaaaggaggcagaattattgagaggaaaccctctgttaaacaatcagccaacaactttcagcgtgaagcgaaggtgggatgatgatgtggttttcaagaaccaagctcgcggtgaaatgaaggcaactaagcgcttcatcaacgacac

SEQ ID NO: 672 - DNA, 701 bp, Vinca minor
cataagcttcctcaactatcactagcagtactgctactactgttttgttcacttgtcagctccgagattatcttcgaggagcgctttgaagatgggtggcaaagcaggtgggtgaggtccgattggaaaagggccgaggggaaagcaggttctttcaagcacactgctggaaagtggtctggtgatcctgatgacaaaggtattcagacatcaacagatgctagacattttgccatatctgcaaaaataccggaattcagcaacaagaatagaacattggttatacaatattccataaggtttgagcaagatatygaatgtggtgggggttatataaagcttctgtctggatttgttaatcaaaagaagtycggtggtgacactccttacagttttatgttcggtccagatatttgtggtacacagacaaagaaacttcatgtaatatattcctaccagggccagaattaccccatcaagaaggacctgcaatgtgaaacagacaagttaacccatttttatacatttattctaagacctgacgcgacatatagtattctgatagatggtcgggaaagagattcaggaagcttgtataccgattgggatatcctccctccaagcacaatcaaggatgtgaatggaacaaagcctgctgattgggatgaccgggagtatatcgaggatccacatgaactccc

SEQ ID NO: 673 - DNA, 561 bp, Petunia x hybrida
agtactgatagcaccagtagtagtgctgttaataaagtggatgcggatactgactgcttggattatgaaatcttgtgggaggacatgacaatcggagaacaaattggacaaggttcttgtggaactgtttaccacgcgctgtggttcggatcagatgttgcggttaaagtattttccagacaagaatattctgatgatgtcatatattccttcagacaggaggtgtcactaatgaaacgtcttcgacatccaaatattcttcttttcatgggtgcagtaacttcacctcaacgtctctgcattgtcacagagtttctaccacgaggaagttcgtttaggttgctacagaggaatgcatccaaactagaatggagacgtcgtattctcatggctttagatatagctcgtggcatgaactatcttcatcatttcaacccacctatagttcatcgggatctgaagtcttcaaatcttcttgtggacaagaactggactgttaaggtcggggactttggtctgtcacgtcttaagcacgagacatatctaacaacacagagtggg

SEQ ID NO: 674 - DNA, 976 bp, Petunia x hybrida
ttatactaagacttgtaatacatggctaggaagatgctgattgatggagagttggacaaacccagtcaggaagaagaacgctatgactttgatttgttcgtaataggtgctggaagtggtggagttcgagctgggcgattttcagcccaaaatggagctaagtgttgcaatctgtgagcttccatttcatcctgtcagctctgaagttcttggaggagttggtggaacgtctgtgattcgttggtttgtgttcctaaaaagatcttggtttatggagcagactatgggccagagctggaggatgcgaggaattatggatgggaagtgaatgagagagtcgatttcaactggaagaagcttttgcaaaagaagactgcggagattatacggttaaatgagatctataagaggctactctcaagtgcaggagttaaactctttgaaggtgaaggaagggtgattggtcctaatgaagttgaggtaatccaactggatggcaccaagataagctattcggcaaagcacattttaatcgcaacaggtagtagggctcaccgtccagggattccaggacaggagctagccataacttcagatgaagcattgagcttggaagagttaccaaagcgtgttgtgattcttggtggagggtatattgctgttgagtttgcctcaatatggcgaggaatgggtgcaacggtggatctatttttcagaaaggagctcccactgaggggttttgatgtcgaaatgcgagctgtagttgcaagaaatctagaaggccgaggaatcaatttgcatccttgcacgacattgaccaagctcgagaaaacagcagatggcatcaaagtgcacacagaccatggtgaagtgattttggcagatgtcgtgctctttgcaactggtcgtctccccaacacaaaaaggttgaatctggatgctgttggtgttgagcttgacaagatggaagccgtga

SEQ ID NO: 675 - DNA, 1253 bp, Pinus taeda
aattcggcacgaggcagcagctttagcacaagtagcagtgctgtgcaaaagctggaaatggatgttgacagcttggactatgaaattctatgggaggacctaacaattggagaacaaatmgggcaaggttcttgcggcactgtctatcatggtctttggtatggttcggatgtagcaataaaggtcttcagtgagcaggaatattccacagaactcattgacacttttcgaaaagaggtgtcactcatgaaaaggctgaggcatccgaacatacttctttttatgggggcagttacatcttgcgagcggctttgtattgtctcagaatttcttccaagaggtagcttgtttcgcttgcttcagagaaatacaccaggaatggattggaaacgacgggtgcggatggctttggacatagcacgtgggatgaactatcttcatcatcttaatcccccgattgttcaccgtgacttgaaatcatcgaatcttttggttgacaaaaactggactgtgaaggttggagattttggtctmtcccgtctcaagaactctacatttttgactgccaagtctggaaaaggcacgccacagtggatggctcctgaagttcttcggaatgagccttccaatgaaaagtccgatgtctatagctttggagtagtattatgggaactggctactgagaagattccatgggaaaatcttaatcctatgcaagtggttggagctgtggggttcatgaaccagcgattagagataccacaaggcttggactctaattgggcatccattattgaaagctgttggcatgatgatacacaatgccgtccaacattccaagaacttatagaacggttgaaagacatccaaaagcactattctgggccttcgcctcaaaaatcrtaggcagcgtcaactgtttggagagacaatcaatagcatattgataaagtttgtacaataacatttgccattttctttgcccccactccccttcaaaagaagggaaagtagcagtgagtgtacccttggtacatatcttgcatgatgaatcatatcgaattattttatcctttgcttgttggtggcatgcaatagtagcagttattcagtattttcccaagaaatccacgaagtgccaagtccttcgctgcactgattttatatttcaatgatcaggttataaaaaatatgtataaatgaaggaaggagagtgaaaatgttttagagggaataagaaaatatgttcatgg

SEQ ID NO: 676 - DNA, 1787 bp, Pinus taeda
gagggyaagggaccgagtcagaccgcgggcaggggttcagcaaagtctgtcatcaataccattgaggcaaccctttcctcataaataattcccatccatcttcctttcatcttctctgcaattctatctccgttggcccaggttgcgggatcgaatcacctcccgaaatccataaaagcatcgatgcagccctgcgggttctttatattcgccttcccctctgaattctaacgcaagcggaaaaatttcctgtaatttctgacctgtattggctccagttgagtttcaaaatcatttatagcgtttttggcttctttgagctggccacagcaagatctggtttgcaggagttcggccgcttgaaaattttgtaggttttcataaggagggcattaaaggggtcgcttagatttgatcgatcgtgggaaaatgagctttcaggatttagaagcgggccgccccttgtctgtaaggagagaggccataaatgggaagcaagacccgtctcaggccgtggctgctggtgtttttcaaatcaatactgccgtttcgacgtttcaaaggcttgtcaataccctcggaacgcccaaggatactccagaactcagggagcgattgcataagactaggcaacacattgggcagctggtaaaggacacatctgctaaactgaaagctgccagtgaaactgatcagcatacggcagttagtgcaaacaagaagatagcagatgcaaaacttgcaaaagattttcaagctgttctaaaggagtttcagaaaggccaacggcttgcagctgaacgtgagacagcttatacaccctttattccccaagcagtattgccttcaagctatgttgcaagtgaattgaatttaagtccagacaaaacgcaggagcagcaggctgttctcatagaatctaggagacaggaagtccttcagttagagaatgaagttgtatttaatgaagccattattgaagagcgggaacaagggatacaggagattcagcaacaaattggagaagtcaatgagatatttaaagatcttgcagttcttgttcatgagcaaggagtcatgattgatgacattgattctaatattgagagttcatactctgcgactgtacaagctaaaagtcaacttcacaaagcttccaagagtcaaaaatctaactcatctctgacttgcttgctactcgtaatttttggcgtggtgttgcttattgtcatcatagttcttgcagcgtaattggtgacctgttcgagtgtctatttggtatcctttgttttttaatctacaacggtgtctgcagcttggggtgggacaaacttggacctgtttactatttcttgggtacaatttttgatgtatctgaaatgctgggtccctttctccgtattcaatacccctaatgtttccttgctttttggcagggtgtttaggttttatgacaaatatggttagtggtatgattcattttgtatcgagagacgaaaaaactagtcgtgtgtattatatatggtcgagtcatttgtttgatagttctaggtatttaagcatgcacaaggatgatttgtgcctagtaatgaattgctgttttaaagtttgtgcagctgtagttatgcttgttgggggagccattgtttcgttttgtatctacaatttattgttctatcactaacaaattcgttaaactgctggcattgtaatttgtgacagctttattcttttgcttctctcatatttctttcctaataaatacctaccctttcctgctaaaagaa

SEQ ID NO: 677 - DNA, 834 bp, Ananas comosus
cagcgagagagagagagagagtgtccagccggggagctcgctccgtcgatggccgccgagaccgatgatcagctcctcaagagcttcctcgccgaggtcagcgaagtcgagcgggacaacgaagtccgcaggattctttcatgcttccagttaaatccttttgagcatcttaagttaccatttgattcatctcctgatgaagtgaagaagcaataccgcaagttgtctttgctggttcaccctgataagtgcaggcatccccaagcaaaggaagcctttgcagcactggcaaaggctcagcaattactgcttgatccacaagaaagggattatattcttaaccaagtcagtgccgcaaaagaagagcttaggttaaagaggaagaaagagttgaagaaggacaatgcttcgaaaataaaggcactggtagatgagggaaagtatgaagtgcagtataagcaatcagaagaatttcagcagcagttaaagataaaagttcgtgaaatattaactgagcaagaatggcgtcgaaggaaaatgcaaatgaggatatcagaagaggaaggaaggctgaaaaaggatgaagaagagacaaaggagatgatgaaaaggaagcgtgaacatgaggaacagtgggaggaaacaagagatcggcgagtttcaagctggagaggttttatgaagtctgggaagaaggtaagaaaggcgagataaaacccccgaagctcaagacagaagatccgaacaaatcttacgtgcaaaggccggtaaagcgcggatgaaaccagcaccatttacgggcccttcgatcttattagatgagcagctgaatgg

SEQ ID NO: 678 - DNA, 949 bp, Ananas comosus
tattgctgttgaattcgcctcaatctggagaggttttggtgttactgtagatttattctaccgaaaagaacttcctctacgaggttttgatgatgaaatgagagctgttgttgcaagaaacctagaaggaaggggtatcaagttgcatccgggaacaaatttgaccgagctgagtaaaacggatgatggcataagagttttgacggatcatggcgatgaaattactgcagatgtcgttttattcgctacaggtcggggtcctaatacgaagaggttgaacttggaagctgttggtgtcgagcttgataaaaaaggagctatcaaggtcgatgaatattctcgctctactgttccaaacatatgggctgtgggtgatgttacaaaccgattgaatctcacacctgtagcattaatggagggaacttgcttcgctaaaactgtttttggtggtcagccgactaaacctgattataaagatataccttgtgctgttttctccatccctcccctttccgtggtaggcctcagcgaacagcaagctatcgagcaagggaagagtgatgttctggtttacacatcaactttcactccgacgaaatacactatatctggacgacaagaaaagacactcatgaagctcattgttgattctgaaactgatcgagttatcggtgcatctatgtgcggcccagatgctgctgaaattatgcagggtatagctgttgcactcaactgtggggctacaaaagcacaatttgatagcactgtcggaattcacccgtctgccgctgaagagtttgtgacgatgcgaactttaaccaggcgtgttaacgcgggatctaaacccaagacaaatttgtaagaaaattagaatattgaagaaaaacctcaaaagccaaagaatattattatgtacttgaatttgtcatcatgcaataacctgtaccgg

SEQ ID NO: 679 - DNA, 790 bp, Ananas comosus
tagctgtcaagtactacacagatgattggccatcgcatgctgcaaagttagcatttgagaagtctgtctttaccaagactgagaaaacaaatgctcggacagaagcagaaatagtgatgtttgatggatacattgtagtctacaagttcattcaggatctacatttttttgtcacgggaggagacaacgagaatgagcttattttagctacagttcttcagggattttttgatgccgtcgaccttcttctcagaaataatgtagataaaaggacagcacttgagaacctggatctgatctttttatgcctcgatgaaattgttgatagagggattgttctagaaaccgaagcaagtgttatagctgaaaaggtcgcatcccacagccttgatggagctacatccttttctgagcagactatatctcaggccctagccacggctcgagaacacttggcgagatctctcctaaaataatgtgcgtaccatgtgtggcaccgcgggttgtgctctgcggaatgtttgcactctgaagttcatttctggtctgtctgggatggatttgcagtttttgtaggtttcgtgggcaaaattggtcatttgggaagttaatgatcttcttttctctctcttcttgtttgtttttaccctattctgggggggaaaaagaactagtttttacagactttcttttgctttacttccgtgaaagctcttgcgaagcaaaatgtattatggaatttgtagttatagacatttcttaggtgattgttaatctctggatttgctcc

SEQ ID NO: 680 - DNA, 2171 bp, Populus trichocarpa
caccattacaagtagcaagtgagggttcgccttaggttttggcaaactacatacttccttgtttctttcttacaacaaacagaaaccgttttatttgtttctttactaagctaaaaacactcacacctctctgtctaggaatcccaaatctaacgccatctttttctcaagattcttgactccaaacctgaaatctccccctcctgttatttttctgttcgtttcctctgaaacagttaagtggattgctttaatatacgttctccgtttcgtttgatctttcgcttccaagcctttctctctcttttaagatctaccaaaattcggaggataatggatcacttccacaacaacgatctcgagtacgtagttaatgatccttttgaagacgattttttcagcgaagatgaacctcaaagaaacgacgattctgatgatgctatgaattctgattttgaagatgactttgtgtcgagtaagccgaagaccgatacgtctgctttagaggcaagaaatggcaaggatatacagggaatcccctgggagaggcttaatttcactagagataagtatcgtgagacgcgtttaaagcagtataagaattacgagaacctctctcgccctcgcttcgagcttcacaaggaatgcctggaagttgagaagggaaagactttctatgactttgagttcaacacaaggcttgtcaaatccacaattgttcattttcaggactgtcatctccttatttcagccttttaagcagggtggaagttctatctgagcagctggcgcagttaaagattcgttgtttatatgctgaggaatctgctgtgggcaacatcaaagaatgatgtttatcttatgcaaaattactcagttatgcattggtcatcactactgcggcgaggcaaagaagtactcaatgtggccaagccagttgctccaacccggcaaagcccaggattgttgtctcagtcactctccagagtgcagataagcactatggctgtcaaagagaacttaatggtggcaggtggtttccagggagaacttatttgcaagtgtttggatcaacctggagttgcattctgctcaaagataacaacaggtgaaaatgccataaccaatgcagtggatgtataccgtaaccacaatggctcaatgaggattatggccgcaaacaacgatgctcaagttagagtatttgatgccgaaacttttgcttccctcaattgtttctccttcgattggtctgtaaataacacctctgttagcccagatggtaagctgcttgcagtgcttggggacagtgctgagtgcttgattgccgatgctaattctgggaaagtgactggaagcctcaaagggcatttggattattccttttcatcagcctggcaccctgacgggctaattttggccactggaaaccaagacactacatgcaggctgtgggatataaggaatctgtcccagtcccttgcagtattaaaagggaatatgggagcaataagagctctaaagttcacctcagatggcaagtttttggctatggctgagcctgcagatttcgtccatgtttttgatacacaatctgattacctcaaatgccaggagattgatctatttggggagattgctggcatttctttcagccccgatactgaagctctttttgttggtgttgccgaccgtacttacggtagcttgttagagttcaacaggaggcattacaatttttacctggactcaatattctagtgaaccttccaccgacggaggcttaagtactgtgcatattaatgttacatattaatgttatttttagcgtgttggagcttgttagtctttgaagttggcaacagcaatccaaggacgcatacccagacggaaactcagttcccacacctgggttttttgagttgcttactttccagtcaaatcagagcatcgggccttcgagaagccaccctttttttttttcttctttttttgtgaagacgaattctttaaagtggtagaaatagaacaattttggtggtgttgtaaatcttccaggagatgctgtgtttatctggagaacatattagctttaattagttaaattttacttttagatacgtcttccggttttgattcattactctgctggaaaaccgaatttctctcgt

SEQ ID NO: 681 - DNA, 1595 bp, Populus trichocarpa
ccctctgaaaacactcagctctctctctcctctggaatcccaaatccaactccttcttttccccaagattcctctgttatttttctgctcgtttctcaggaaacagataatggatcacttccaaaacaacgatctcgagtacgtagttgatgatccttttggagacgatttattcagagaagacgagcctcaaagaaacgacgatttggatgacgctgtggactccgaatttgaagatgacttcgaatcgagtaagccacagactgatacatctgctttagaggcaagaaacggcaaggatatacagggaataccctgggagaggcttaattttactagagataagtatcgtgagacgcgtttaaagcagtataagaattacgagaacctctcgcttcctcgcttcgagcttgataaggaatgcttggaagtagagaagggacagactttttatgactttcagtacaacacaaggcttgtcaaatccacaatcgttcattttcagctgaggaatctgctctgggcaacatcgaaacatgatgtgtatcttatgcaaaattactcagttatgcattggtcatcactactgcggcatggcaaagaagtactcaatgtggctaaaccaattgctccgacctggcaacgcccaggattgttgtctaagtcactctccagagtgcagataagcactatggctgttaaagagaacttgatggtggcaggcggcttccaaggagaacttatttgcatgtatttgaatcaacctggagttgcattctgcacaaaaataacaacaggtgaaaatgccataaccaatgcagtggatgtatatcataaccacaatggctcaatgaggattatggttgccaataacgatgctcaagtcagagtatttgatgctgaaacgtttgcttcgctgaatactttctcctttaattggtctgtaaataacacctctgttagcccagatggtaagctgcttgcagtgcttggggacagtgctgaatgcttgattgccgatgccaattcagggaaagtgaccggcagcctcaaagggcatttggattattcctttgcatctgcctggcactctaacggacaggttttggccactggaaaccaagacactacgtgcaggctgtgggatataaggaatctgacccagtcccttgcagtattaaaagggaatatgggggcaataagaggtctaaagttctcctcagatggtcgctttttggcaatggctgagcctgcggacttcgttcatgtttttgatacacaatctgattacgtcaaatgccaggagatagatatatttggggagattgctggcatttctttcagccccgatacagaagctctttttgttggtattgctgaccgtacttacggtagcttgttagagttcaacaggaggcattgtaatttttatttggactcgatattctagtgcgcacctttgtacatattaaggttattttgtgtgtgagcttgtttgtctttgaagttcacgcccttgtttatttggggttgcggaatttcctgtcaaatcagagcatcgattttttaagagtatctttattcatggttgtcaa

SEQ ID NO: 682 - DNA, 2084 bp, Populus trichocarpa
caccattacaagtagcaagtgagggttcgccttaggttttggcaaactacatacttccttgtttctttcttacaacaaacagaaaccgttttatttgtttctttactaagctaaaaacactcacacctctctgtctaggaatcccaaatctaacgccatctttttctcaagattcttgactccaaacctgaaatctccccctcctgttatttttctgttcgtttcctctgaaacagttaagtggattgctttaatatacgttctccgtttcgtttgatctttcgcttccaagcctttctctctcttttaagatctaccaaaattcggaggataatggatcacttccacaacaacgatctcgagtacgtagttaatgatccttttgaagacgattttttcagcgaagatgaacctcaaagaaacgacgattctgatgatgctatgaattctgattttgaagatgactttgtgtcgagtaagccgaagaccgatacgtctgctttagaggcaagaaatggcaaggatatacagggaatcccctgggagaggcttaatttcactagagataagtatcgtgagacgcgtttaaagcagtataagaattacgagaacctctctcgccctcgcttcgagcttcacaaggaatgcctggaagttgagaagggaaagactttctatgactttgagttcaacacaaggcttgtcaaatccacaattgttcattttcagctgaggaatctgctgtgggcaacatcaaagaatgatgtttatcttatgcaaaattactcagttatgcattggtcatcactactgcggcgaggcaaagaagtactcaatgtggccaagccagttgctccaacccggcaaagcccaggattgttgtctcagtcactctccagagtgcagataagcactatggctgtcaaagagaacttaatggtggcaggtggtttccagggagaacttatttgcaagtgtttggatcaacctggagttgcattctgctcaaagataacaacaggtgaaaatgccataaccaatgcagtggatgtataccgtaaccacaatggctcaatgaggattatggccgcaaacaacgatgctcaagttagagtatttgatgccgaaacttttgcttccctcaattgtttctccttcgattggtctgtaaataacacctctgttagcccagatggtaagctgcttgcagtgcttggggacagtgctgagtgcttgattgccgatgctaattctgggaaagtgactggaagcctcaaagggcatttggattattccttttcatcagcctggcaccctgacgggctaattttggccactggaaaccaagacactacatgcaggctgtgggatataaggaatctgtcccagtcccttgcagtattaaaagggaatatgggagcaataagagctctaaagttcacctcagatggcaagtttttggctatggctgagcctgcagatttcgtccatgtttttgatacacaatctgattacctcaaatgccaggagattgatctatttggggagattgctggcatttctttcagccccgatactgaagctctttttgttggtgttgccgaccgtacttacggtagcttgttagagttcaacaggaggcattacaatttttacctggactcaatattctagtgaaccttccaccgacggaggcttaagtactgtgcatattaatgttacatattaatgttatttttagcgtgttggagcttgttagtctttgaagttggcaacagcaatccaaggacgcatacccagacggaaactcagttcccacacctgggttttttgagttgcttactttccagtcaaatcagagcatcgggccttcgagaagccaccctttttttttttcttctttttttgtgaagacgaattctttaaagtggtagaaatagaacaattttggtggtgttgtaaatcttccaggagatgctgtgtttatctggagaacatattagctttaattagttaaattttacttttagatacgtcttccggttttgattcattactctgctggaaaaccgaatttctctcgt

SEQ ID NO: 683 - DNA, 1362 bp, Populus trichocarpa
cttcctttctctgtcccttctctctctctctctctctctaaaatcatcaaaacaattttctcaatccacgccgtgttattagcttctcatcttcttcttcttcttcttcttttttttttttcatttaccttaatcgattcttacaactgtatccaaacaacccgcttctctcccctttctcgggaaaatcccctcgttatctctcgagaaactgctggttggggttagggattttcaatcgacagttcgattaaattttagtttaatcgaattaaaataatataataataatgagctttcaagatctggaggcagggcgacccttggcatcttcaaggagagaactgatcaacgggaaacaagatgccacgcaagcggttgcttctggaatcttccagatcaataccgccgtgtccacttttcagcgtcttgttaataccctcgggactcctaaagacacgcctgagctccgggagaagctgcatagaacaaggctacatattgggcaattggtgaaggatacttcagccagacttaaacaagctagcgaaacagatcattatgctggagtcagtcaaagcaaaaagattgctgacgctaaattagcaaaagattttcaagcagtcttgaaagaatttcagaaggctcagcggcttgcagctgagagggaaactgcatacgcaccttttgttccccaagcagtccttccttccagctacacagccagcgaggtaaatgtaagttccgaaaaaagtccagagcagcgcgccctccttgtggagtcgagaagacaggaggtcctactactggacaatgagattgtcttcaatgaggctattattgaggagagagaacagggaatacatgaaattcagcagcaaattgatgatataggctcccatatcgaaagtgcccaggctgcaacatcacagggaacatcccaactcgtgaaagctgcaaagactcaaagatcaaattcatctctggcctgcttgctcatggtgatattcgggattgtgattctcattgtgatcgtagtacttgcagcctaatccaaaaaaaatctttatagaatccttgaactgtttcaagagctgcttggcaacaagatagtaatgtctctgctagttccttggttatgttctttaacaagacatggtgactgactggagtttctcactgctagtcagaggtggtatatattgtatgatggctgcagatgatcattttgggctgctttgtctgtcttgtctgtttctattttccgctgcctcgggtttacaagggtgtgtgactgattgttcaattgtttcgagttttatagtaatattaataaacataacatccattcttttctttcca

SEQ ID NO: 684 - DNA, 1367 bp, Populus trichocarpa
cttcctttctctgtcccttctctctctctctctctctctaaaatcatcaaaacaattttctcaatccacgccgtgttattagcttctcatcttcttcttcttcttcttcttttttttttttcatttaccttaatcgattcttacaactgtatccaaacaacccgcttctctcccctttctcgggaaaatcccctcgttatctctcgagaaactgctggttggggttagggattttcaatcgacagttcgattaaattttagtttaatcgaattaaaataatataataataatgagctttcaagatctggaggcagggcgacccttggcatcttcaaggagagaactgatcaacgggaaacaagatgccacgcaagcggttgcttctggaatcttccagatcaataccgccgtgtccacttttcagcgtcttgttaataccctcgggactcctaaagacacgcctgagctccgggagaagctgcatagaacaaggctacatattgggcaattggtgaaggatacttcagccagacttaaacaagctagcgaaacagatcattatgctggagtcagtcaaagcaaaaagattgctgacgctaaattagcaaaagattttcaagcagtcttgaaagaatttcagaaggctcagcggcttgcagctgagagggaaactgcatacgcaccttttgttccccaagcagtccttccttccagctacacagccagcgaggtaaatgtaagttccgaaaaaagtccagagcagcgcgccctccttgtggagtcgagaagacaggaggtcctactactggacaatgagattgtcttcaatgaggctattattgaggagagagaacagggaatacatgaaattcagcagcaaattggtgagatgatataggctcccatatcgaaagtgcccaggctgcaacatcacagggaacatcccaactcgtgaaagctgcaaagactcaaagatcaaattcatctctggcctgcttgctcatggtgatattcgggattgtgattctcattgtgatcgtagtacttgcagcctaatccaaaaaaaatctttatagaatccttgaactgtttcaagagctgcttggcaacaagatagtaatgtctctgctagttccttggttatgttctttaacaagacatggtgactgactggagtttctcactgctagtcagaggtggtatatattgtatgatggctgcagatgatcattttgggctgctttgtctgtcttgtctgtttctattttccgctgcctcgggtttacaagggtgtgtgactgattgttcaattgtttcgagttttatagtaatattaataaacataacatccattcttttctttcca

SEQ ID NO: 685 - DNA, 1289 bp, Populus trichocarpa
atggatttggggagaagggtaagccagcatctggcgatgaaagtgctgttccacctaatgctaatattcagattactctggagttggttgcctggaagactgtgacggaggtaactgatgacaagaaggttataaagaaaatcttgaaggaaggcgatggatatgatcgcccaaatgagggggctgttgtaaaagtgaaattgattgggaagttgcaagatggcacagtattttttaagaagggacaagacgacagtgagttgtttgagttcaagacagatgaagagcaagtaattgatggacttgatagagctgtgtctacgatgaagaaaggtgagctagcccttttgaccattgcaccggagtatgcatttggctcatctgagtcgcagcaggagctggctgttgttcctccaaactctactgtgtgctatgagatagagctggtttccttcgacaaggagaaggaatcatgggacatgaatactgatgagaagattgaagctgctggcaaaaagaaggaagagggcaatgtgttgttcaaggctggaaaatatgcaaaggcatctaaaagatatgagaaggctgtgaagtatatagaatatgattcttcttttagcgaggaggagaaaaagcaggcaaaggcactgaaggtggcctgcaacctaaacaacgctgcctgcaaactgaaattaaaggattacaaacaggcagagaagttgtgcaccaaggtattagagttggagagtagaaatgtgaaggctctctacagaagagcccaggcttatattcagctggcagatttggatctggctgagtttgatattaagaaagctcttgagattgatcctgacaacagggatgtcaagctggagcacaaaactttgaaagaaaagatgaaggaatacaataagaaggaagccaagttttatggcaacatgtttgccaagatgtctaagttgggatctcttgaatctaataaagcagaagctaaggaggcagagcccatgagtgtagacagcgaggcatgagcagagagtaaacaagttggcactggactgttacaacaaggcagagtaaaattctaatcattttcttttaattaacaattcaaggttttgccttggtacctaagactgcttcggtctggtgttttttccgtttatggtaatggatttttatctgctaccagtataagatttcattaactatcattgtaaacagctttgctccgttgaatttttctcgatttctctagctgtgctatgaagttgtctggattttacata

SEQ ID NO: 686 - DNA, 1425 bp, Populus trichocarpa
cttcctttctctgtcccttctctctctctctctctctctaaaatcatcaaaacaattttctcaatccacgccgtgttattagcttctcatcttcttcttcttcttcttcttttttttttttcatttaccttaatcgattcttacaactgtatccaaacaacccgcttctctcccctttctcgggaaaatcccctcgttatctctcgagaaactgctggttggggttagggattttcaatcgacagttcgattaaattttagtttaatcgaattaaaataatataataataatgagctttcaagatctggaggcagggcgacccttggcatcttcaaggagagaactgatcaacgggaaacaagatgccacgcaagcggttgcttctggaatcttccagatcaataccgccgtgtccacttttcagcgtcttgttaataccctcgggactcctaaagacacgcctgagctccgggagaagctgcatagaacaaggctacatattgggcaattggtgaaggatacttcagccagacttaaacaagctagcgaaacagatcattatgctggagtcagtcaaagcaaaaagattgctgacgctaaattagcaaaagattttcaagcagtcttgaaagaatttcagaaggctcagcggcttgcagctgagagggaaactgcatacgcaccttttgttccccaagcagtccttccttccagctacacagccagcgaggtaaatgtaagttccgaaaaaagtccagagcagcgcgccctccttgtggagtcgagaagacaggaggtcctactactggacaatgagattgtcttcaatgaggctattattgaggagagagaacagggaatacatgaaattcagcagcaaattggtgaggtgaatgagatttttaaagacctcgctgtccttgtccatgaacaaggagctatgattgatgatataggctcccatatcgaaagtgcccaggctgcaacatcacagggaacatcccaactcgtgaaagctgcaaagactcaaagatcaaattcatctctggcctgcttgctcatggtgatattcgggattgtgattctcattgtgatcgtagtacttgcagcctaatccaaaaaaaatctttatagaatccttgaactgtttcaagagctgcttggcaacaagatagtaatgtctctgctagttccttggttatgttctttaacaagacatggtgactgactggagtttctcactgctagtcagaggtggtatatattgtatgatggctgcagatgatcattttgggctgctttgtctgtcttgtctgtttctattttccgctgcctcgggtttacaagggtgtgtgactgattgttcaattgtttcgagttttatagtaatattaataaacataacatccattcttttctttcca

SEQ ID NO: 687 - DNA, 1746 bp, Populus trichocarpa
gcatcatctgaatgtgaagagcttgaagagtcaaaaaaccgagttggaaatgcaaaggaacaacggcttccaggtccacaaccccttccactcccttcacctcagggtggtgctgtactgaagcctatgagtagctttaaagcagtgaattgcagtggccctctctatgcttctggaccattaccgcgtcctccaggtggaacactgagaaacttttcatatgaagaaattctatctgcttgccgcaatttctcttcagatcgatgtgtatctgaaggtctttcatccataatgttctgggcttcctttggggatgatgcttcaagttcaaagaggttcgaagctagtgttactcgccttcattcatcatctcagggtttaaaagagtttataaacgaggttaatacccttgcatctttgcaacatccaaacttgtgcaaattgcttggctatcatgcacgtgatgggtctgaccagagaatgctggtgtatgagaggctttatcatggaagcttggatcggctgctgtatggaagatctgatgggcctcccattgactggaacaccaggatgaaaattgccttatgtgctgcacaaggtcttacttttttgcatgaagaaggacctttccaggcaatgtacaatgagttctctactgccaacatacaaatcgacaaagacttcagtgcaaagctttcaggatatggttgtgttggccatattcctgaaacagagatctctaacagttcagtggctgcagcaaatctctcagtggagacagtagagagagggttattgactccaaagagcaacgtttggagctttgcaattgttcttcttgaactactcactggccggaagaatcttgatagccgtcatcctagggaagagagaaacttagttaagtggacccggccttttctagctgatgactgtcgactatcgctgattatggatcctcagttaaaatgccgtttcccagcaaaagcagcccggacattggctgacattgctctaagatgtcttcagaaggatccattggaaagactaaccatgagaaccattgttgagcatctcaaagttatacaagacatgaaatactccagtcgctttcctctgcaagaaccagctgcagttgctggaaagcaaatgtccagatcacctagtcttaatggaattattaccccaacaccaaggttaagtttctcacaatctccgccgtcaagagcccggccatccatttccccgactaggcctcgtgctttacctctctctcttcctcctcgtgcatgttcctcaactctctctcttgaggaactggaactggaactggaacggcaagaaagcaggaaatcatcatcatcagctgttcgaaggccaagtgttgaaggattttgattgttaatatatgcattttttcattttttgaatggcttttcttttttaccccttttggtgattcaacagaacatatagaaagataaagatgtggatcttccaccttcccatcccctaagatgttgaaaaaagagtggatgctagcctgtagatagagtgcaaaccctagttcaactggattcaatcagtttcattgtaatcaacaaagccatatacaatgattagtgttccaaactcatgcctcatgcttgttcatgctcttcaatgatttgttgattacaaatcattgcatgaacgtgccccccatcagttttgaatgaaatagcaaaactccactccttggtctcc

SEQ ID NO: 688 - DNA, 1444 bp, Populus trichocarpa
acagaatctacgccaagcttgcttttataaagtggccagtgaaagtaaaaagccatggctttggtgggactatgtgactgatttttcaatccgttgcccaatgaaggacaagaaatacaccaaagagtgtgcagatcaagttatccaatcccttggtgttgatcttgagaagatagataaatgcataggagaacctgaggcagatgtggaaaacgaagttcttaaagctgaacaagatacacagatcggaaaagggtctcgaggagatgtgactatacttccaactcttgtaataaacaacaggcaatatagaggtaagttggacaaaggagcagttcttaaggcgatatgtgcaggttttgaagagaccacggagccagccatatgcttaagtgaagatgtagaaaccaacgagtgtctagaaaacaatggtgggtgctggcaggacaaggctgctaaccttactgcatgcaaggatacttttcggggtagagtatgtgaatgtcctgtggttcagggggtgaagtttgttggtgatggttatactcgctgtgaagcttcgggttctttacgttgtgaaattaacaatggaggatgctggaagaaaactcaagatggcaggaccttttctgcttgtgttgaagatcattctcaaggttgcaagtgtcctccgggattcaagggtgatggagtaaattcctgtgaagatgtggatgaatgcaaagacaagctggcctgccagtgttcagaatgcaaatgcaaaaatacctggggcagttatgactgcagctgcggtggtggtttattgtatatgcaagaacatgacacgtgcataagtaaagctgccaacacaaattacagctggagctttgtttggattattattcttggcttggctgctgctggtgttgctggatatgcaatttacaagtacagaatccggagatacatggattcagagatacgggctatcatggcacagtatatgccattggatagtcaagcagacatccctgttcatcatgctccccgtggggacatctgaaggtgagctagtgagatgatgtgctgaggcatcgagtaaagaagcagcatctccaaatttcgaagtgacctatcagcttcgatttggcttgtagctatttcagccagcacgctcccatttagtcacacgtatatgtaaattaatattacaagttctgcctgtaattccatggaacacagcaagttttcaattcaatgtaagaagcgttatgggattcaaaatttttggccatcttggttgcattccagtttcttgctgcctaggttatcaaggatttttccttggtttctaaaactaattcaagttgtccttctagctgagagtgatcataagtcctgtgaaggtggacattttacattgtatggcttggatcttaataataactgtttttagatcaat

SEQ ID NO: 689 - DNA, 1421 bp, Populus trichocarpa
cacacatcatcattccatttcctctcccttctctctctccaagtctaagatcatctaaacaattctctctcaattaacgccgtgctataagcttctcatctttccattaaccttaatagattcttgttcctgtacccaaacaaccagcttctcttccctttctcgaaaaataaaaaaaatcccctctttttatctttcgagaaagggctggtcagggattttcgatcaaattgaatcgaattatataataataataataatgagctttcaagatctggaggcgggacgacccttggcatcttcaaggagagagctgatcaacggcaaacaagatgccacgcaagcggttgcttctggaatcttccagatcaacactgccgtttccacttttcagcgtcttgttaatacccttgggactcctaaagacacgcctgagctccgggagaagctgcataaaacaaggctacatattgggcaattggtgaaggatacttcagccagacttaaacaagctagtgaaacagatcattatgctggagtcagtcaaagcaaaaagattgctgatgctaaattagcaaaagattttcaagcagttttgaaagaatttcagaaggctcagcggcttgcagctgagagggaaacggcatatactccttttgttccccaagcagtccttccttccagctacacagccagtgaaatagatgtaagtttagataaaagtccagaacaacgtgctctccttgtggagtcaagaagacaggaggtcctactattggacaatgagattgccttcaatgaggctgttatcgaggagagagaacagggaatacatgaaattcagcagcaaattggtgaggtgaatgagatttttaaagatcttgctgtccttgtccatgaacaaggaactatgattgatgatattggctcccatattgaaaattcccaggctgcaacagcacagggaaaatcccaccttgtgaaagctgcaaagactcaaagatcaaattcttctctggcctgcttgctcatggtgatattcgggatagtgattctcattgtgatcgtagtacttgctgcataatccaaaaattttcgtgatacaatccttggaactatttcaagagctgcttggcaacaagatagtaatctctatgctaattcctttatgttcttttacaagacatggcgactgattggagtgtcccactgctagtcagaggtggtgtatattgtatgatgtctgcacgtgatcattgcaggcaattctgtctgggtggagtgtctgtttgtttctatgttctgctgccttgggtttacaagggtgtgtgacagtttgtgtaattgtttcaggttttatagaaatattaataaactaaacatttattcttttgtttttaatcattctcgaattatcttcc

SEQ ID NO: 690 - DNA, 1987 bp, Populus trichocarpa
aaaattgaccgttcttttatataggcaggaagactgtgtccaggtgcccaaaatcaaatcaaaaacctcctcctcctactccctctctatcgcggcatgaagctttaaatgggtggaaaggtcgacgttccctttaatcacttataaaaagaaaactctcctctacctccatacttccctaccatttatttctcctccttcgctaatcaatctctacaaagttaaaattcaattttacaatcatgccaagaaagatgcctatcgatggggaagtgaaccaagctagccaagtagaagaagatgcccactttgattttgatctgtttgttattggagctgggagtggcggtgttcgtgctgctaggttttctgctaattatggagctaaggttggaatttgtgagcttccatttcatcctatcagctcagaagtaaatggaggggttggtggaacgtgtgttcttcgcggttgtgttcccaagaagattttagtttatggagcaaattttggaggtgagattgaggacgccaggaattatggttgggaaatcaatgaaaaggtggacttcaactggaaaaaactgttgcagaaaaagtcagatgaaatagtcaggctaaatggaatttacaagaggttactatctaatgctggggttaaactgtatgaaggagagggaaaggttgccggtcctaatgaagttgaactgacacaactagatggcactaaattgaaatactcagcaaagcacatcctgattgcaactggcagtaaggctcagcgtcccaatattcctgggcaggagttgggcataacttctgatgaggcattgagtttggaagatttaccaaagcgtgcagtagtgcttggtggagggtacattgctgttgagtttgcttcgatatggcgtggcatgggtgctactgtggatctatttctcagaagggaacttccgttaaggggttttgatgatgaaatgagggctgtggttgcaagaaatcttgaaggcaggggaattaatttgcaccccagaacaaatttgacagagttgactaaaacagaggatggaattaaagttcgcacagatcatggagaggagctgttggcagatgttgtactttttgccaccggtcgagctcccaatacgaagagattaaatttggaagctgcaggcgttgagcttgataaaacaggagctgtgaaggttgacgagttctctcgcaccaacatacctagcatatgggctgctggtgatgtcacaaaccgaatgaatcttactcccgtggccttgatggagggatcatgctttgctaaaactgttttcgcagggcaacctaccaaaccagactacaatcacataccatatgctgtgtttagcattcctcctctctctgtagtgggcctcagcgaggagcaggcattagaccaagcaaatggtgatgtgttggttttcacttctacctttaatcctatgaagaacactatctctggtcgacaagagaagacagtaatgaagcttgttgttgatgctgagacggataaagttcttggagcttccatgtgtgggccagatgcacctgaaattatgcagggtattgctgttgcattgaagtgtggagcaaccaagcaacaatttgacagtactgtgggaatacacccatctgctgctgaggaatttgtgaccatgcgttcagtggcaaggcgtgttactgcaagtggcaaaccaaagacaaatctgtaaaaatatcagctcaaaaagaaaatcacaggaaaatcattgagttatcaccaataaaagttcatgtcattataggattttgaaagcctggtagctctgtttctattacagaaaagtaatttaatgccaaagtaatatatgtcttattttggattggcaccatacccttcctttatggtggatacgaactactatctcagaaccagtgtttgaggaggtaggtcgttttatttacatttacgttgttgtga

SEQ ID NO: 691 - DNA, 1161 bp, Solanum tuberosum
gggaagactgtctcaagtgtaactgacgataagaaagtaataaagaagatcttaaaagaaggggaaggattcgagaaaccgaatgcaggggctgtggttaaaatgaaattgatcggcaagctacaagatggcacagtcttcataaagaagggccacaatggagaaaatgaagacgagcttttcgagtttaagacagatgaggagcaagttatagatgggttggatagagctgtcatgtcaatgaagaagggtgaagtggcactgctaataattgcacctgattatgcctttggtccatctgaatcaaagcaagacttaggcgttgttcctcccaactcaactgtatattatgaggttgagctggtttcctttgtcaaggaaaaggaatcatgggatatgaatacccaggagaaaattgaggctgctgtcaaaaagaaagaggaaggaaatgctctcttcaaggctggtaaatatgcaagagcatcaactagatatgagaaggctgctaaatttattgaagatgatactgactttagtgaagaggaaaagaaacaagctaaagctttgaagatcagctgcaacttaaataatgcagcttgcaagttgaaactgaaagattacaagcaggcggagaagctgtgtaccaaggtgttggaaactgagagtactaatgttaaagctctttaccggagagctcaagcatatatgaacatgacagatcttgatctagctgaatttgacataaagaaagcccttgagattgatcctaacaacagggatgtgaagcttgaatacaaagctctgaaggagaaagttaaggaattcaataagaaggatgcaaaattctatgggaacatgtttgctaagttaaataagttggatgccaactagatgtaagtttcagacacatgatttctagagtctatgtagctccatgttgtttgatgaccagttcatgacacactttatctttgtgcaaaactccgcttccaaggaaccacaaaccaatgagcttttagacaagcaaaggcataagttgtctttaagcagacaaagtcttactttcatggcgcgttgttacgttgtctgtgcttggatctcttgatgccgggaaaaaactaaactgcaaatgtttaatcagtcttagcatttagtagactt

SEQ ID NO: 692 - DNA, 2432 bp, Solanum tuberosum
cttccctttacttgttcaaagactggagctttttcatagtattaattaattattcacctgaatgctttgatctgggtgacatcaagatttgatttttcatgtaaatttgcagtttttaggggtttagctgatctgggtcatctttatttttctccatctgagggaggaagtgaagatgaaggtagggtttttagtgtgtatatggtttgtgttgtgtggttgttgtatgggaagatttgtggtggagaagaacagcttgagagtaacatcaccagactcaatcaaagaggtgtatgagtgtgcaattggcaactttggggtaccacagtatggaggaaccatggttggtaatgttatgtacccaaaaactaatcaaaaatcatgcaagaatttctcagattttgatatcttctacaaatctaagcctggtggcatgcctgttttccttcttgttgatagaggagattgctttttcacactgaaggcttggaatgctcagcaagctggagcaggtgctattcttgttgctgatgaccgtgttgaacctttaattaccatggacacccctgaggaagaggatgcaaaggcagattatttgcaagatataactattccatcggctttaattagcaaatcacttggggatagcattaagaaggaactatctaaaggagaaatggttaacataaacctcgattggagagaggctcttccacatcctgacgatcgagtggagtacgaattttggaccaatagtaatgatgagtgtggccccaagtgtgaaagccagagagagtttgtcaaaaacttcaagggggctgcccagatacttgagcagaaaggttatacacagtttagtccccattacataacttggtattgcccggaagcgtttattttgagcaagcaatgcaagtctcagtgcatcaaccatggaagatactgtgctccagaccctgagcaggacttcagtaaaggttatgatggaaaggatgttgttttgcaaaatttacgtcaagcttgcttttttaaggttgcaaatgaaagtggaaaaccctggttgtggtgggattatgtcactgactttgcaatacggtgtccaatgaaagagaagaaatacacaaaagaatgtgctgatcaagtaatcaagtcacttggctttgacgtcaaacagattgaaaattgtgttggagatcctgaagcagatactgacaaccctgttctaaaggctgaacaggacacccagataggtaagggcgctcgtggagatgtgactatcttgccaactctcgttataaacaatagacagtacagaggtaagctggacaagggagcagtcctcaaggcaatttgttcaggttttgaggagacaaccgagcctgcaatttgtttaactgaagaaatagaaacaaatgaatgcttagaatcaaatggtgggtgctggcaggacaaggctgctaacattacagcatgccaggatactttccgtggtagagtatgtgaatgcccagtagttcagggagtaaaatttgttggtgatggttatactcactgtgaagcatctggagcattgcggtgtgaaataaacaatggaggctgttggaagggaacccaaaatggcagggcatattctgcttgcattgacgatcacacaaagggttgcaaatgtccaccaggattcaaaggggatggagttaacagttgtgaggatattgatgaatgcaaggagaagttggcttgccagtgtgctgagtgcaaatgcaagaacacttggggtagttatgattgcagttgcaacgccaatttgttgtacatgcatgaacatgacacgtgtataagcaaagatgccaagtcagagttcagctggggccttgtttggactatcatcttgggtttggctgttgcaggggtttcggcatatgctgtgtacaagtatagaatccggagatacatggactcagagattcgtgccatcatggcacaatatatgcctttggatcaaggagagggggcaactaatgttccccacgggaacgtctaatgatagaccattactgaagagtgatgatggcttgggtagaatgcagcctccactggatgtctgccaccagttagtcagcctaaagttctttgtgccaatcatcatcgaaacaaattacatcttatttatgtacatgtatgtcccaacaatgcacataaacccaataaaaggaattgtccttgaattggatttgcgcatgatgtttgacttctaataataaggaaatgcgcaatatcagtttgtattccacttgaaagcatcattttgcattgcacaatatggtatgaatggatggtaaggtgtcatattatgccatcacttcctgttttggagtgaggcatgattagttaattgattgatatcatctcttttgctcttgtaaaaaaaggta

SEQ ID NO: 693 - DNA, 1581 bp, Solanum tuberosum
atttctctagatcttctccttttctcaattttgtccaaaaagtttctttatggatacattgttcttcgatataatcaagaagtttgattgctctgtttgttcaacgccagctttgccttttgattcctttctttttcatcgtctgtgttttagtcaaccttgtatttgcttctaacctttgttagctggaggctggagctgtcaccatgggtagaagaagttcacaacgtaggaatgctgctatgctggatagtgatgacactgatagcgtgagttcatcatcaactactcggtcagacatgatgttgtctggtttagaggaggttcaatttgataaggagactgtccttgatcaatgcgtggatgccctttatgagaaaaggggatcaacaagagagaaggctttggcatctattatagaagcattcaatagcaacgtacaacatgaatttgttgaaaagaagtttgccacattattgcaactatgtttgagttccattagacgtggttcctccaaggagatagctttggcatctcatgttattgggcttctttctttaactgctggccctggggacaaagcacacgagattctggaagaatcagtaaaacctatctcagttgctcttaaatctcgatctgacaattctaaaatatcgtcgttactggagtgtttggccatcatcacctttgttggtggcaaagatccagaggaaacagaagagtctatgcaattgatgtggcaagtcatcaatccaaaactgggtcccaatgtggctactgctaaaccttcaccagcaatgataacagcagttgtatcttcttggtctttccttcttacgaccatggatggatggacacttaacccaaaaagttggcaagggtcaatctcctacttctcaaatcttctagacaaggaagaccgatctgtgcgcattgcagctggcgaaacacttgctttagtttttgaagtcgagatatattggaatttctagaggatgggtatagtcccgaaacctcagccaagattggtggactattggttagcacaagtacttgggctaatctgatacagttaaacttccttaagcacttccttggagggggatttgtgaagcatatgcaggaaaatgagtttcttcatgatgtatttggtttcacaccaaagaagaatctcccagcttctcagcaccgtgtatctggaactgataagagaatgtacaagtcgccaaattctatccttaacaaggccaggactcaatttctaaacaagcaaagaatgttgtcccaggacaagaatgtcggctactatgcgggtggtgatgagctctgaacaagcagttgcagcaacacagtctcagcaaaaaaaggacaattttcctttgtgtcatactattcattcatagtcacagatttaatgaacaaaatgatttaaaaagatagttatttgatcattttggttgctacttggtagtattcccttatttttctttttcgttatgtaataaaatacatttgacttgttgcctctgatggagttcatcagtagtgcataagaaatgccagccactttctgtgaaa

SEQ ID NO: 694 - DNA, 1667 bp, Solanum tuberosum
ggctctttccaagaatgaaaaaagaaaaagtctactactaggcttctcacttgaatcatttctactagttttgttactgttttcaattattacatcttcattatctgagatcttctttgaagaacaatttgatgatgattggcagagcagatgggtgaagtctgactggaaaaggagtgaagggaaagcaggctcctttaagcatacagctgggaaatgggctggtgatcctgatgataaaggtattcagacgtcaagtgatgccaaacatttcgccatatctgctaagataccagaatttagtaacaagaatagaacattggttgtacagtactctataaagcttgagcaagacattgaatgtggtggaggttacataaagcttctctctggatatgtcaaccagaagaaattcgggggagacactccttacagtatgatgtttggaccggatatctgtggtacacagactaagaaacttcatgttatactttcctaccaaggccagaattatccaatcaaaaaggatctacaatgtgaaacagacaaattaacccatttctacacattcattcttagacctgatgcatcgtacagcatctggattgatggccgagaaagggattctggaagcatgtatacagactgggatatctttcctcctcgaaaaattaaagatgtaaatgcgaaaaagcctgcagattgggatgatagagaatatatagaggatccaaatgaggtcaaaccagagggatatgaatctattccaagagagatccctaacccaaaagctaaaaagcctgatcactgggatgatgaagaggatggcatctggagaccaccaaaaattcctaatccagcatataagggtccatggaaacgaaagaaagtaaagaaccctaactataaaggtaaatggaagaccccttggatcgacaatccagaatttgaagatgatcctgatctctatgtgctgaggcctaccaaatatgttggaatcgaagtttggcaggtcaaagcaggttctctatttgacaacatactgatatgcgatgaacccgattatgcaaagaaagtgattgaggaagtctttgctaatagggaggctgaaaaggaggcttttgaggaggcagagaaagtgagaaaagcaaaagaggaagaggaagcccaaagagcaagagaagaaggtgaaaggaggagaagtgaaagagatagagataggggtagggacaggcacagagatagaaacaagaggcgctatcgccgtgattatgatgatgactatcatgatgaactttgacttggtgttaaaggccacacagcatcttccattcttgagacagaaatatggttccattcatttgggctttgtgtgttcttcttgttgtatttcactcttaacggtaactttatttttgcatagtccaatgtgttaggcttaagacaagacagattgtactatttccatcttatttagcttttttggcaaagcaaaacatggctcaatatttgaaaatccaattaataatgtaaaatccagttgattatcgagttgagggtctattagaaacaatcactctaccccacaagggtaagggggtaaggtctacgtatatctcaccctcttcaaaccttacctgtggaaatatacatgggtttgttgttgt

SEQ ID NO: 695 - DNA, 1535 bp, Solanum tuberosum
aaagctcaaaaagatttcttacttctcttcttcatcaaaattcaattttctctccattttcttccaaattccccaaaacccaacttccaaaacttaataatcttgacatatttgtgataaaaatttgatcttgtttgtctctgtacatataattacagattcttggtttttgggaatttcacctgaaaattttgcccttctcaatttccttacaaattgcccaaaccccatttttttattgtgatcaagatttgattttgtttgtctctgtgtatttaactgtagattttgattgttgggtagttgagatttttcgaaaaaaatagaacaaaagtatgagttttcaagatttggaatcgggtcgacctttggggtctcgtcggttccagacaaatgggaagcaagacccaacccaagcagtggcttctggaatcttccagatcaatactgctgtgtctacatttcagaggctagtgaatacacttggtaccccaaaagatacgcctgagctacgtgaaaagttgcacaagacaagggtacatattggccagttagtcaaagatacatctgctaaacttaagcaagcaagtgaaacagatcatcatgctgatgtcagtgctagcaagaaaataacagatgctaaacttgctaaagattttcaagctgtcttgaaagagtttcaaaaggctcagagacttgcagcagagagggagacagcatatacacctttcattccccaaaccgttcttccttctagttacacagccagtgaggtagatgttgcttcagataatagtatggaacagcgagctctccttgtggaatcaagaaggcaggatattttgcatttagacaatgagattgcttttaatgaagctattattgaggaaagagatcttggaatacaagaagtacaacaacagattggtgaagtgaatgagattttcaaggatcttgccgttcttgttcatgagcaaggaactatgattgatgatattggctccaacattgagaattctcatgctgctactgcacaagggagatcacaacttgctaaagctgcaaagacccaaagatcaaattcatctctgacctgcttgcttctggtgatatttgggatcatacttctaattgtgatcatagtacttgcagtatgatcagaagattttgatatgggaggaagagagatcctaaactcttcataaatggaattgatctttttgattcaagatgttcttaaggcaccataaagtatacttgtggtttgatccatgaatcttttagtcatgctagagaagttgtgcaactgtgacatgaagtttcatatgctgtgtggtggcgtgggggtggacatgcgagggaaggtttgtctgctatgtttgtaaattttgtgtttgtgtttgcaattgtgtgttactgccatgtaatggctggtttgttgataaaatttgattcttaaatctcttgcatgatcaaggccccgataaaactaatctagtccacaacttattcatgatataagctgtcatttacat

SEQ ID NO: 696 - DNA, 2243 bp, Solanum tuberosum
aagctagggtttttagtgtgtgtttggtttcttgtaattgggtcttgtttgggtagatttgtggtggaaaagaatagcttgagagtaacttctccagactcaatcaaagatgtgtatgagtgtgcgattgggaattttggggttccacaatatggaggaactatggttggtatagttgtgtaccctaaagctaatcagaagtcctgcaaggattttgcagattctgatatttcattcaaaactaaggctggtggtatgcctgttttcgtccttgtcgatagaggagactgctatttcacacttaaggcttggaatgctcaaaaggctggagctgctgctattcttgttgctgatgatcgcaatgaacctttgattaccatggacacccctgaggaagaggatgcaaaggcagattatctgcaaaatataactattccatcagctctaattagtcaatcgcttggggatagcatcaagaagcaactatctaaaggggagatggttaacataaacctggattggagagaggctcttccgcatcctgatgaaagagttgagtacgagttttggaccaacagtaatgatgagtgtggtcctaagtgtgaaagccagagagagtttgtcaaaaacttcaaaggggctgcccagatacttgagcagaagggatatacacaattcagtccccattacataacttggtattgtcctgaggcatttattttgagcaagcaatgcaagtctcagtgcatcaaccatgggagatactgtgctccagatcctgagcaagacttcagcaaaggttatgatgggaaggatgttgttttacaaaatctgcgccaagcttgctttcataaggttgccaatgaaagcgggaagccgtggttgtggtgggactacgttactgactttggaatccggtgtccaatgaaggagaagaagtacaataaggagtgtgcagatcaagtaatcaaatcccttggctttgatgtaaaacagatagataaatgtgttggagatcctgaagcggatgctgataaccctgttctaaaggctgaacaagaagcgcagattggaaagaactctcgtggagatgtgactatcttgccaactcttgtgataaacaataggcagtacagaggcaagttggacaagggagctgttctgaaggccatttgttcaggttttgaggagacaactgagcctgcaatttgcttaaccgatgatatacaaacaaatgagtgcttagagtccaatggtgggtgctggcaggacaaagctgctaacattactgcatgccgggatactttccgtgggaaagtctgtgaatgcccgacggttcagggagtaaaatttgttggtgatggttattctcactgtgaagcatcgggagcattacgctgtggattaaacaatggaggttgttggaagggaaccaaggatggaaggacattttctgcctgcatagatgaccacacaaagggttgtaaatgtccaccagggttcaaaggagatggagtgaatgtttgtgacgatattgatgaatgcaaagaaaggctggcatgccagtgtccagattgtaaatgcaagaatacctggggtggttatcaatgcagttgcagtggcaatttattgtacatgcaagaacatgacacatgtataggcaatgatggaaaagcagcatttagctggggtcttgtttgggttatcatcttgggtttggcagttgcaggagttggagcatatgccgtgtacaagtataggatccggagatacatggattcagagatccgtgccatcatggcacagtacatgcctttggataatcagggagaggtgcctaatcacatatcccacggaaatgtctgatattattccattggtgaagaatgattgcgcggatagaatgtaacatcaagtgatatcgcgatcagctctttttccagttgtcacgaggttctttatgcttgtgtcattctagtgcaaactctcactgttcagcgaggtcctatttatgtatatgtttatcataacagtacacacataaactcccaattatgataggggaaattttccaaaacatgcactatggtcctgagcttaatgaatggagaaatttcttgggaacaaacttggtgccaccatagataatgtttgcagcatgaacgcgatggattccgtaaatagaaaaattatgttagttaaatggagattactctttcttatgcggtgatttataattttta

SEQ ID NO: 697 - DNA, 2343 bp, Solanum tuberosum
cccttcgtcaccgcctaaaagctctctcaaaaaccttggaacacctctagaacctaaaccctttcttttcacactatctatcacaccatttaagcctccatcttcttcatctccaacacgccattatttactttcactgagctcgattctatcaatcaatcaatcttctgtgtgtgagtgcatattgtgtttgacgggaaaatggacgaggattttggtattccaccggtagagggaatgaacgaggacatggatctgccggatgacagttcgaccctgaaagtaggcgaggagaaggaaattggaaatcagggattgaagaagaagcttgttaaggaaggtgaaggttgggatactcctgcgcctggtgatgaagtcgaagttcattatactggaactttgcttgacggaaccaagttcgattccagtcgcgatagaggggaccccttcaagtttactctcggtcaaggacaagttattaaaggatgggatcaaggtataaatacaatgaagaaaggtgaaaatgctattttcaccattcctccagagcttgcttatggagagagtggttctcctccaactatccctccaaatgccactctacaatttgatgttgagttgctatcatgggtgagtgtaaaagacatttgcaaggatggtggaattttcaaaaagatcctcacagagggggagaaatgggaaaacccgaaagatcttgacgaagtatttgtcaagtacgaagctcagcttgaaaatggcacagtggtgggaaaatcagatggagtggagttcactgttcaagatggtcatttctgtcctgctcttgctaaggctgtgaaaactatgaagaaaggtgaaaaggtccaattgacagtgaagccgcaatatggctttggagagaaaggaaaaccagcctcgagtgatggaggagcagttccacctaatgccacattacagatcaacttagagttggtctcgtggaaaactgtttcaaatgttactgatgacaagaaagtattaaagaagatcttgaaagaaggggaaggatatgaaagacccaatgaaggagctgttgttaaattaaaactggttggcaagctgctagatggcacagtcttcacaaaaaagggccatgatggggaaaatgaagacaatctttttgagtttaagacagatgaggaacaagtaatagatgggctggaccgagctgtcttgacaatgaagaagggtgaagcggcgctgcttacaattgcacctgaatatgcctttggttcatctgagtcgaagcaagatttagctgttgttcctcctaattcaactgtgcattatgaggttgagcttgtttcttttgtcaaggacaaggaatcatgggatatgaataccccggagaaaattgagtctgctggcaaaaagaaagaagaagggaatgcactgttcaaggctggtaaatacgcaagggcatctaagagatatgagaaggctgctaaattcatcgagtatgatacttccttcagcgaggaggaaaagaaacagtctaaagcattgaagatcacctgcaacttaaataatgcagcctgcaagttgaaattgaaagattacaagcaggccgagaaactgtgtaccaaggtgttggaactggatagtgcaaatgtcaaagctctttaccgcagagctcaagcatatatgaacatggctgatcttgatctggctgaatttgacattaagaaagctcttgagattgatcctgacaacagggatgtgaagcttgagtacaaagctctaaaggagaaagtcaaggaaattaacaagaaggacgcaaagttctacggaaacatgtttgcaaagttgactaagcaggatgcagcaaactcagccaactctgctcctaaggaaccagaaccgatgagcattgatagcaaggcataactttaactcagatatgacataaaaaggatcagcatcattatctagactgttccaatgagatgtcatatttaccatggagtcgttatagttggattttaggaaaaagtgtttgctgaataacttgactgtaatttctgattctgcattgggtacttatattaatggatcctcttgtaatagagtttcatctggcgtctttggtgtgacatcttttagttaattgtgttttgtccttttgttgagtggaatttattgaaggtcattcgaaattgatgtaggcaaaatcagttcttgaattgcaagcaaaggccgtacttctagaaataatgattgtgtacaataatagtagtaaaaattatgtaacggcgggatttggacaaaatcgaagaaacagaagaaatctctgatgcttaagac

SEQ ID NO: 698 - DNA, 1498 bp, Solanum tuberosum
gcctatacatagtaaaagcttaatacaccgagttattttatttatttttgtctatataaacaacctcatagctcacaatttaagaaatttcagaaaatctaaatttatcttctctccaatttcctaaaaacttgcaacacttttcttctctctctacattttgcttacttgtaagataaaaatgggcgttcaggaaatggatcctcttacacagctaagcttgccacccgggtttcggttttacccgactgatgaagagcttttagttcaatatttatgccgtaaagttgctggtcatgatttttctctacaaattattgcagaaattgatctgtacaaattcgatccatgggttctcccaagtaaggcgatttttggagaaaaagaatggtatttcttcagtccaagagatcggaagtatccaaatggatctagaccgaacagagtagctggttctggttattggaaagcaactggaactgataaaataattactacggaaggtagaaaagttggaatcaaaaaggctttagtgttttatattggtaaagcacctaaaggaactaaaacgaattggattatgcatgaatacagactcagtgaacctacaacgaaaagtcgaagttcaaggctcgacgattgggttctatgtaggatttacaagaagaattccggtgggcaaaaaccgagttgttctgatttacagagcaaggatataaacaatggttcatcatcgtcatcctcgtctcaatttgacgatatgctggaatctctaccagcaattgaagatcgatatttctcattacctagagtgaattccattaggaattttcaacaagacgaaaagctcaatcttcaacaattgggttctgggaactttgattgggccactatagcgggattgaactcatttccggaattagcttccggaaatcaagttccagcaccggggaatcaaactccggtgcttatgaacacaaatcagtatcacaatcacaaccacaacagcaatttgaataatttcaatgaatttttcgccaattcaacggcgttaaattttcacagcgaagttaagtttgaaggaggagttgatcaagaagtagaaagcagtgttagagctcaacgacttaacagcgttaacccgggtttcttccaagagaactcaaccgggtttccgagtttttatacgaactcggtgcccgacccgtttgggattcggtacccgacccaaacagtaaatatgggttttactgggtaaatagtggaagggtaaaatgtgaatgctcatagattaacttgaagacaatttggaaaaaattgtcatgattattgaggtggaaagggcatttattctttggttggggactaaaatagcaaaaaaaagttaacaagattttgttcatgcaattatgcacatatacaatgtattttgttgtactaaaatttaaggctttggtaatgtacttataggaatacaaattggaggatttgattagct

SEQ ID NO: 699 - DNA, 756 bp, Solanum tuberosum
gaagagtcaaaaatggaaatagtaatgttcccatggcttgcttatgggcatttaatcccatatatgaatctgtcaaatgaaattgcaaaaagaggtcataaaatctcattcttgttgcccaaaaatgctgaaattatacttcaaaaattcaatcattatccaaatctcatcaaattacataaactgacaatacctcatgttgatggccttccatatggagcagagactacagctgatgttcatacatcattggagagtctattagcaacagcttttgatgaattgtatgatgaaatcaaatcttttcttcaaaatctaaaaccccattttattatctttgattttgcttattggattcctgatttagcactagaaattgggggcatcaaaactctgttttacagagttgtttgccctgctgtatcatctgcaacattgattcgatcaccggataaggctatttttatggcatcaactgcagctgaattagtaaagccaccaccaggttacccttctactactgtggtgttgcgcgaatgtgaagctaagttgttgtcatttatatttcatgaatatggcaagggggtgacattttatgaacgaattaagaagggaatgacacgatgtgacgcaatagctatgaaaacatgtagagagattgaaggaaacttttgtgactacatctcaacaccattcgaaaagccagtcctttacacaggaacctgctaatttctggagccgaaaaaaagagcttta

SEQ ID NO: 700 - DNA, 2825 bp, Solanum tuberosum
tagagttatgggagataatagaggacttggtgttttgggtgtttcaatgtgtggtgcagcacaagaaatagaacaattatcaagagaaagtagtcattatagtctttctactggaattttgccttcacttggtgcaagaagtaatagaagagtcaagcttaaaagatttattatttcaccttatgatcgacaatacaggttatgggagacatttctaattgtgctggttgtttacactgcttgggtgtccccgttcgagtttggctttctaggaaaaccagaaggaccactcgctaagacggacaatgtagtcaatggattcttcgcgattgatatcattcttaccttctttgtagctttcttggatagagccacttatctacttgtcgatgaacacaaaaagattgcttggaagtatatgagtacttggttcttatttgatgtcatatcaacaatcccttcagaacttgctgtgaagatttccccaaaacctttacgtcagtatggattattcaatatgcttcgtttgtggcgtctaagaagagttagttcattgtttgccagattggagaaagataggaacttcaattacttttgggttcgatgtgcaaagcttgtttgtgtcactctttttgctgttcattgtgccggatgcttttattatcttatcgcggcccattatcctgatcccaagaagacatggattggggcctctatggatgacttccttaatcagagcttatggattcgttatatcacttctatttattggtcgataactactctcactacagtcggttatggagatctgcatccagagaatacgcgggaaatgatctttgatatcttctacatgctctttaacttgggattgacagcatacttaataggaaatatgactaacttggttgtacacgggacgagtaggactagaaaatttagagatacaattcaagctgcttcgagctttgcacagaggaaccaattgcctgctcgtctccaagatcagatgcttgcacacttgtgcttgaagttcagaacagactcagaagggctgcagcagcaagagacactcgagtctcttcctaaagccatccgttcaagtgtttcacattttcttttctactctttagtagataaggtttacctgtttcgtggagtgtcaaacgatctactcttccagctggtctccgagatgaaggcagagtactttcctcccaaagaggatgtcattttgcagaatgaagcaccaacagacttctatattcttgtaacaggagctgtggatctagtggttcttaaaaacggagttgaacaggttgtcggggaggtcagggcaggtgatctttgtggtgaaatcggggttctttgttataggcctcaactatttacagtacgaacgaagagactgtgccagctactacgtatgaatcgtaccacatttctgaatatcgtccaggccaatgttggggacgggacaataatcatgagtaatctccttcagcatttgaaggaaatgaagaatccaattatggagggtgttctacttgagaccgagcatatgctagctcgcggtagaatggacttgcctctcaccctttgctttgcaacacttagaagtgatgacttattgttgcatcacttgttgaaacgcggtcttgatccaaatgaagcagataacaatggaagatccgcgttgcatatcgctgcgtctaaaggcattgagaactgtgtggttcttctgctcgatttcggggctgatcccaatagtagagattcagaaggcaatgtgccattgtgggaggctatcatggggaagcacgagtcagttatccagttactcgttaacaacggtgctaaactatcagctggtgatgtgggacatttcgcctgcgttgctgttgaacaaaacaacttgagtttgctcaaggagattgtccgttatggcggggatgtcacgcttcccaagatcaatggttcatcagctctccatgttgctgtttgtgaaggtaacatagaaatagtaaagtatctcttggatcgaggggctaacgttgatcaaccagacgaacataattggaccccccgggaccttgctgagcaacaaggacatgaagacatcaaagaactctttgaatccagggtaatgatgagaactcgatccgttgatcctatccccgaggaacgatgtagatttcttgggaggttcaaaagtgaaccaacaatcacccctgcatcccatggagtctcatttctaggactagacggatcattagggcgttcacgtcctagacgtaggtctaataacttccacaactcattattcgggataatgtcagcaaagcagaccaatgagcacgaccttttatctgcaaacgacagtaatgtaagtgtcatgacaaccaagacttatgctccccgagtgacagtgtgttgccctgagaaaggagacaacgggggaaaactcattttactcccacagagttttaaagagctacttcaaattggttctagtagatatggtatctctcaggccaaagttgtaagcaaagatggagctgaaatcgacgaaatagagttgatcagagatggtgatcgtttagtttttgttagcgataaagataacaatattgatgaagctaaatcatcagaattgtagtgagtttaggtgaaaaccaaaattgttctttatttttgtagttaattgagtgtaaactaattcacagcccatttgtggaacatgtaaagctcagaatgagaaaatatatgtacattcagttacctctttttttctaatatacgaatattgatagttcagaaaaaaa

SEQ ID NO: 701 - DNA, 876 bp, Solanum tuberosum
tttttttctcttatatttcttcattacatagagagtgtgtgaaaaaaaaaaattagagtgaaaaaaaatgggagaagaaattagtaacaaacagatcttactaaaagattatgtaaatggatttccaaaagaatcagatatggaattaaaaatcagtagtatgaaattgaaagttccagaagattcaaatagtgttttggttaaaaatctttacttatcttgtgatccatatatgagacctcgtatgaagaaaactaaaggcagttataccgactcctttactcccggctctcctattgtggggtttggtgtggctaaagttgtggattcagctcatccaaaattcaagaaagatgagttagtttggggaataactggatgggaagaatacagtgtcatcaaggctcctgagactctctttaaaattcacaatacggatgtgccgctttcttactatacaggaatcctagggatgcctgggataactgcttatggaggtttttatgagctatgctctccaaagaaaggagaaactgtgtatgtctctgctgcgtctggagctgttggccagctcgttggacaattcgctaagctaataggttgctatgttgttggaagtgctggaagcaaagaaaaggttgaactgttgaagaaacaagttggtttcgatgaagcatttaactataaagaggaacaagatttatcagcagctttgaaaaggtacttccctgatggaatcgatatctactttgagaaacgtggaggaaagatgcttgacgcggttcttctcacatgagaatccatggacggattgctgtatgtgggatgatctcacatacaacctcgagcaaatgaaggagttcacaacttgttctg

SEQ ID NO: 702 - DNA, 716 bp, Solanum tuberosum
ggccaaattttctctttcttcccttacccccaaagttccatctctttgctctctttccaaatcccccaaaattctagggttttcatttttctgttgaattttggatcggtgctttgttttagtttttgggtagaggttccgattcctggattttgtggcagaattttgggggattccaattgtatattaagagaaagagatgagttttcaagatcttgaagcgggtcgaccattggggacccgtagagggtatatgaatggtaagcaagacccaactcaagctgtggcttctggaattttccagattaacactgctgtgtcgacgtttcaaaggctggtcaatacacttggaacacccaaagatacacccgagctgcgtgagaagttgcacaagacgagggtacatattgggcagttagtgaaagatacatctgcaaaacttaagcaagccagcgaaacagatcatcgtgttgaagtcagtgctagcaagaaaattacagatgctaaacttgctaaagattttcaagcagtcttgaaggagtttcaaaaggctcaaaggcttgcagctgagagagagacagcttatacaccttttgttccccaagcagttcttccttctagttatacagccagtgagatagatgtttcttcagaaaagagtccagaacaacgggctctccttgtggaatcaagaagaccagaggttttacttttgg

SEQ ID NO: 703 - DNA, 1136 bp, Solanum tuberosum
ggtttacacttatttgaaagaagggctaaattcttgctgccttttcttttctcattatatgctccattcaattaatgtttaaaactttgaagtgctttaagccagtatttgaatagtgtttgacatgccatttgtcacgttctatgaatgtcatttgaattcttgattattggttacttttaagaagtggaatgactgctggtttacttttgtaaagtgatgtcttttgcaggatgttgcggttaaagtattttccaagcaagaatattcggatgatgtcatatattccttcagacaggaggtgtcactgatgaaacgtctccgacatccaaatattcttcttttcatgggtgcggtaacttcacctcaacgcctctgtattgtgacagagttcttgccacgaggaagtttgtttaggttactacaaaggaatgcatccaaactagaatggagacgacgtattcacatggctttagatattgctcgtggcatgaactatcttcatcatttcaacccacctatagttcatcgggatctgaagtcttcaaatcttcttgtggacaagaactggaccgttaaggttggggactttggtctgtcacgtcttaagcacgagacatatctaacaacaaagaatgggaaaggaacgccacaatggatggctccagaagttcttcgcaatgaaccttcagatgagaaggctgatatatacagttttggtgttatactatgggaacttgccacggaaaagatcccttgggataacctcaactcaatgcaggtgattggagctgtaggattcatgaatcagcggctagatatccccaagaatgttgatccacagtgggtttctattattgagagctgttggcatagcgagccacagttacgcccaacgttcctagagttggtagataaactcaaggatatgctgaggcagtatgccattcaggctcaggcagcacgtaatgttgcaggagatagcagccagaaggaactatagataacgatggtgtcatgtgctttgaagcttttgtggaatagccagaagatacactgataacacagagccttcagtgactttgattggaagtgtcactcaaaaggtcacaaaattgcgctgaggttggtcggga

SEQ ID NO: 704 - DNA, 1325 bp, Solanum tuberosum
ttttttttctcttcatatttcttcattacatagtgtgtgaaaaaaaaaaattagagtgaaaaaatgggagaagaaattagtaacaaacagatcttactaaaagattatgtaaatggatttccaaaagaatcagatatggaattaaaaatcagtagcatgaaattgaaagttccagaagattcaaatactgttttggttaaaaatctttacttatcttgtgatccatatatgagacctcgtatgaagaaaactgaaggcagttatactgactcctttactcctggctctcctattgtggggtttggtgtggctaaagttgtggattcagctcatccaaaattcaagaaagatgaattagtttggggaataactggatgggaagaatacagtgtcatcaaggctcctgagactctctttaaaattcacaatacggatgtgccgctttcttactatacaggaatcctagggatgcccgggataactgcttatggaggtttttatgagctatgctctccaaagaaaggagaaactgtgtatgtctctgctgcgtctggagctgttggccagctcgttggacaattcgctaaacttgtaggttgctatgttgttggaagtgctggaagcgaagaaaaggttgaactgttgaagaacaaatttggttttgatgaagcatttaactataaagaggaacaagatttatcagcagctttgaaaaggtacttccctgatggaatcgatatctactttgagaacgttggaggaaagatgcttgacgcagttcttctcaacatgagaatccatggacgaatcgctgtatgtgggatgatctcacaatacaacctcgagcaaaatgaaggagtgcacaacttgttctgcctcatctcaaaacgactccgtatgcaaggatttttggctgttgactactttcccctttacaaaaaatttgtcgaaatggttactccacacatcaaggaagggaaggtaaaatatgtggaggacatagctgaaggaattgaaagtgcaccaggtgctctagtcggcctcttctctggtcgaaatgttggaaaacaggtggtgctcgttgctcgtgaataaacttatcgagtgtgtttgatacgatggaaaatactttcgtcgtgtaacttagtaccaacaaataactttctcatgtaaatcatcaagattgatgtgtaattttctctatcatacaaacatatcttatcaagtatgctaagtttgtacaaaccaaaagttgtattgagttttgtggttagtgaactttgtgttgcaatagaagaagacattttgaatgacaataagtcatg

SEQ ID NO: 705 - DNA, 1777 bp, Solanum tuberosum
atttctctagatcttctccttttctcaattttgtccaaaaagtttctttatggatacattgttcttcgatataatcaagaagtttgattgctctgtttgttcaacgccagctttgccttttgattcctttctttttcatcgtctgtgttttagtcaaccttgtatttgcttctaacctttgttagctggaggctggagctgtcaccatgggtagaagaagttcacaacgtaggaatgctgctatgctggatagtgatgacactgatagcgtgagttcatcatcaactactcggtcagacatgatgttgtctggtttagaggaggttcaatttgataaggagactgtccttgatcaatgcgtggatgccctttatgagaaaaggggatcaacaagagagaaggctttggcatctattatagaagcattcaatagcaacgtacaacatgaatttgttgaaaagaagtttgccacattattgcaactatgtttgagttccattagacgtggttcctccaaggagatagctttggcatctcatgttattgggcttctttctttaactgctggccctggggacaaagcacacgagattctggaagaatcagtaaaacctatctcagttgctcttaaatctcgatctgacaattctaaaatatcgtcgttactggagtgtttggccatcatcacctttgttggtggcaaagatccagaggaaacagaagagtctatgcaattgatgtggcaagtcatcaatccaaaactgggtcccaatgtggctactgctaaaccttcaccagcaatgataacagcagttgtatcttcttggtctttccttcttacgaccatggatggatggacacttaacccaaaaagttggcaagggtcaatctcctacttctcaaatcttctagacaaggaagaccgatctgtgcgcattgcagctggcgaaacacttgctttagtttttgaagtcgggagtctggaaaagttttctggtgaatctaaaggatctggtgacagctccacatttgaaactaacaaatctaaggaattattacatatacagggattaagggcaaaagtcctgaaccaagtaagaaccctttcggcagaggctggaggtaaagggtcagccaagaaggatcttaacaatcaaaggaacacattccgagatatattggaatttctagaggatgggtatagtcccgaaacctcagccaagattggtggactattggttagcacaagtacttgggctaatctgatacagttaaacttccttaagcacttccttggagggggatttgtgaagcatatgcaggaaaatgagtttcttcatgatgtatttggtttcacaccaaagaagaatctcccagcttctcagcaccgtgtatctggaactgataagagaatgtacaagtcgccaaattctatccttaacaaggccaggactcaatttctaaacaagcaaagaatgttgtcccaggacaagaatgtcggctactatgcgggtggtgatgagctctgaacaagcagttgcagcaacacagtctcagcaaaaaaaggacaattttcctttgtgtcatactattcattcatagtcacagatttaatgaacaaaatgatttaaaaagatagttatttgatcattttggttgctacttggtagtattcccttatttttctttttcgttatgtaataaaatacatttgacttgttgcctctgatggagttcatcagtagtgcataagaaatgccagccactttctgtgaaa

SEQ ID NO: 706 - DNA, 866 bp, Solanum tuberosum
agaagaagcacttaaacgtgtagcacgaatccaatttcttgttccattttcgcccaatttaggtttggatttctgaattttgatcaaaattcgaagaaatgagcttccaagatgtacatgccggtcgatcatcgggtcctcgtcggagcaatgtcaacgggaagcaagacccgacccaagctatggcctctggaattttccagatcaacaccgccgtttccacttttcagaggctggttaacaccctaggtacccctaaggataccccggagctacgtgacaagttgcacaagacaagactacatattgggcaattagtgaaagatacttctgctaaacttaagcaagccagcgaaacagatcatcgaattgaagtcagtgctagcaagaaaattacagatgctaagcttgctaaagattttcaagctgtattgaaggagtttcaaaaagctcagaggcttgcagctgagagggagacgtcatattcacctgttgttcccccagcagttcttccttctagttacacggacagtgagatagatgtctcttcagataaaggtcaagagcagcgagctctacttgtggaatctagaagacaagaggttgttcttttggacaatgagatttcctttaatgaagctattatagaggaaagggaccagggaatacaagaagtacaacaacagataggtgaagtgaatgagatattcaaggatcttgccgtgcttgttcacgagcagggaaccatgatcgatgatattggttccaacattgagaactctcatgctgcaactgcacaagggagaaacacactttgctaagctgcaaagacccaaagatcaaattcatctctgacctgcttactc

SEQ ID NO: 707 - DNA, 3022 bp, Solanum tuberosum
atgttggaggtagatgagaaggatagggtaccagctggtgggaatcggaaaacatatgcacggtctatttcgtggtccgataggtcccctaccaagtccagtgccaaaccacaatggaacagcaaagcacgggcttgtttgccaccccttcagcctctttccattactagaccaactgctgaggagtggcctagggctggatcagatgatcttggtgtatggcctaatccctctactcctggtgtaaggcttggatcattcagcactcatgaaggttcagctactaagcaggctccgcgagaatttgaattcaagaaagataagcttgctttcttcaataaggaatgttctaagattgtggatcacatctatttaggaagtgacactgtggcaaagaatcgagacattctccgtgagaacggcatcactcatgtcttaaactgtgtagggtttagttgtcctgaatactttaaggatgatcttgtatacaagacactttggctgcaggatagccccactgaggacatcacaagtattctttatgatgtctttgattattttgaagatgttcgtgaacaaggtgggagagtctttgtacactgcttccaaggggtgtcccgatcagcctccttggttattgcatatcttatgtggaaagaggggatgagctttgaagatgcattccagcatgtcaaagctgcaagaggagtgacaaacccaaatatgggttttgcttgccaattgttgcagtgccagaaacgagtgcatgctcaacctgtaagtcctacttctgtgctaaggatgtacaggatggcacctcactccccatatgatccccttcatttggtgccaaagatgctgagtgagccaggagctgaaggactcgattctcgtggagccttccttgttcttattccttctgttatatacgtgtggatagggaagcattgtacctcggtaatgtcagataatgccagggctgcagcctttcaggtaatccgctatgaaaaggcccaaggtcctgttttaattatcaatgaaggcaaagagccttctgatttttggagtgctcttagccaggaaagcttcttttctggtggttgtggtaaagaaaagaccaaggtggacgcccgtttattagctgaaaatgacttgattactgatgatatcagccagtgtattggtcaaaagaatgaatatgatcttgattttgaaattttctgcaaagcactcgccggtggggttgttccaccttttccattgtcaggtactgaatctgagacatgtcttcccgcaagacagaatggatggagtagattgagacggaagttttccagtggaataatgaaagaatttatcacagcttccaagttatacagtcatactggcataacaagtcatgtacatgataagatggacacaattaaagaactctctcctgctttgccttcatcaccttcaagtcctcagtgtggatcaccaaattctttctcttcttatgcaaccagcagtccaagttggacaaaggatccttgtagagatgtggaaaaccctggtcttgatacagaacctgcgctatcgccatctccttcatttagctcacttgattctctctcttgttttcttgttagtaaaccaaagtctaataccacatccccctcactctcaccttcaacctcagattactccagttctttcaccttttctccctcatcttccaattggtctgaccttggcatacctatctgcacagcattcacctacaagatttgaacatgaggatcctaattttgtgaagaatgatttcttcaaagtaagttcatctttactttgtaaaggatcaccctttccagcagcagaggaagcatttccaaccagtcttgctcttagacgggcaaacagttgtttacagtacaaagaaacttccccttcactagcagagcgtagaggcagtcatcctcctcctatgatgatgttacgttccaatgatgattccgctaaaatttcagtgaagttggtgagaacatcatcattttctcttcctaattttgaagacgatacaatgaagtgtgtcgagtgtgatagccttaatgacggagattttgttgataatagtaaagaggagctaatgttagatgttgagaattcgattactgacaatcaactccaaaatggagttcaacctgtagatgatgtatctggcagtttcaatgacaatccaattggcattcccatccgagttgcagaaacaactgatataggtctttatcaatggccatctatgcataaattaggcttgtcttctgtggttttcgattcaaggtccgtttatatcatagtcattcctgacttgagtttagatgaaaatagttccagtagtttgtacatctggattgggcgtgatgtgcaatggaaggaaagttcagatcaagtgatcaacaatgattccatgtgtgaagataatcatgtccattgggagaaagttggactcggttttcttattcagaagggcctggccactagctctctagttcagatagtgaaagaaggtgaggaacctgaacagcttcttaagcatctgccgtatttctcatttgataaggcattagatgttggggtcaagtaggttttgataaaaatgccgcgattaccatttgaggtatgcaaaatccttgctttagtccttctggcaaggatctttggttagtgagcatcccaagcagtaaaagtcgaaggtttctgcttgtgtgatgttgaatgatacaaggagaggattagatttctctcgtcgaaggacatgtacagggaagaagttgctgtataggaggagttgataagtatatatactactcttgttgaaaaataagtatactggtcccttttccctgtccataccatccaactacattcagtaacaaaaggtgtaatgtaatagtccctgcattgggacatttagcattgttacatacccaaattctcttaaatgttttctattataaattgttcaatgtagattggggct

SEQ ID NO: 708 - DNA, 2432 bp, Solanum tuberosum
cttccctttacttgttcaaagactggagctttttcatagtattaattaattattcacctgaatgctttgatctgggtgacatcaagatttgatttttcatgtaaatttgcagtttttaggggtttagctgatctgggtcatctttatttttctccatctgagggaggaagtgaagatgaaggtagggtttttagtgtgtatatggtttgtgttgtgtggttgttgtatgggaagatttgtggtggagaagaacagcttgagagtaacatcaccagactcaatcaaagaggtgtatgagtgtgcaattggcaactttggggtaccacagtatggaggaaccatggttggtaatgttatgtacccaaaaactaatcaaaaatcatgcaagaatttctcagattttgatatcttctacaaatctaagcctggtggcatgcctgttttccttcttgttgatagaagagattgctttttcacactgaaggcttggaatgctcagcaagctggagcaggtgctattcttgttgctgatgaccgtgttgaacctttaattaccatggacacccctgaggaagaggatgcaaaggcagattatttgcaagatataactattccatcggctttaattagcaaatcacttggggatagcattaagaaggaactatctaaaggagaaatggttaacataaacctcgattggagagaggctcttccacatcctgacgatcgagtggagtacgaattttggaccaatagtaatgatgagtgtggccccaagtgtgaaagccagagagagtttgtcaaaaacttcaagggggctgcccagatacttgagcagaaaggttatacacagtttagtccccattacataacttggtattgcccggaagcgtttattttgagcaagcaatgcaagtctcagtgcatcaaccatggaagatactgtgctccagaccctgagcaggacttcagtaaaggttatgatggaaaggatgttgttttgcaaaatttacgtcaagcttgcttttttaaggttgcaaatgaaagtggaaaaccctggttgtggtgggattatgtcactgactttgcaatacggtgtccaatgaaagagaagaaatacacaaaagaatgtgctgatcaagtaatcaagtcacttggctttgacgtcaaacagattgaaaattgtgttggagatcctgaagcagatactgacaaccctgttctaaaggctgaacaggacacccagataggtaagggcgctcgtggagatgtgactatcttgccaactctcgttataaacaatagacagtacagaggtaagctggacaagggagcagtcctcaaggcaatttgttcaggttttgaggagacaaccgagcctgcaatttgtttaactgaagaaatagaaacaaatgaatgcttagaatcaaatggtgggtgctggcaggacaaggctgctaacattacagcatgccaggatactttccgtggtagagtatgtgaatgcccagtagttcagggagtaaaatttgttggtgatggttatactcactgtgaagcatctggagcattgcggtgtgaaataaacaatggaggctgttggaagggaacccaaaatggcagggcatattctgcttgcattgacgatcacacaaagggttgcaaatgtccaccaggattcaaaggggatggagttaacagttgtgaggatattgatgaatgcaaggagaagttggcttgccagtgtgctgagtgcaaatgcaagaacacttggggtagttatgattgcagttgcaacgccaatttgttgtacatgcatgaacatgacacgtgtataagcaaagatgccaagtcagagttcagctggggccttgtttggactatcatcttgggtttggctgttgcaggggtttcggcatatgctgtgtacaagtatagaatccggagatacatggactcagagattcgtgccatcatggcacaatatatgcctttggatcaaggagagggggcaactaatgttccccacgggaacgtctaatgatagaccattactgaagagtgatgatggcttgggtagaatgcagcctccactggatgtctgccaccagttagtcagcctaaagttctttgtgccaatcatcatcgaaacaaattacatcttatttatgtacatgtatgtcccaacaatgcacataaacccaataaaaggaattgtccttgaattggatttgcgcatgatgtttgacttctaataataaggaaatgcgcaatatcagtttgtattccacttgaaagcatcattttgcattgcacaatatggtatgaatggatggtaaggtgtcatattatgccatcacttcctgttttggagtgaggcatgattagttaattgattgatatcatctcttttgctcttgtaaaaaaaggta

SEQ ID NO: 709 - DNA, 2033 bp, Solanum tuberosum
atttagagccagaacccttacttcttctaaacttggacttgatccacagcagcccctgcaagctgccattgcctccaaaatttctaattttgttagtaactgtctttgtttgggtagttgtctggttttcttttgctttctttatgttctcttactgtcttctttatgttttcttactgtcataataggcctcaaaggtgagcaataaggttaagtcaaaaataaagacaggagagagcagcatgtttcgtgaaggcggaagtggagatagtcattattctgaccatgcattttctgatgctgctcctctcagatcaccagggaggatgcaaattcaagtggagcaagtaacacctaggggagatgttctacccttctccttttggagtattctctaatcttgtaaaagtggagcattctggggatgagagtgagggaaaacaaggcatttctaagattatcacctcgaaggcagaggcgtggatggcgaagaatagcttatcatggccatggaaaggcaatgagcgagaagcatcagagtcaagaactacacgatctgtgtggccttggttaaacaatgaccaagacaatgagttaaatcacatcaacagttctaatacagttaaaccagaaaatcaggttactgaaacataccgtacaaccactaatgaagctccaggatcctggtcttcatttaatattaacagcacaagcagtgttagtagctatggaagcacctgcagtagtgctgttaataaggtggacatggatactgattgcctggattacgaaatcttgtgggaggacttgactatcggagaacagattggagaaggatcttgtggaactgtttatcatgggctgtggtatggatcagatgtcgctgttaaagtgttcaccaagcaagaatattctgatgaagtgatatattccttcaaacaagagatctcccttatgaaaagacttcgacatccaaatattctattcatgggtgctgttacttcaccgcaacgcctctgcattgtcacggaattcctgccacggggaagtttgttcaggctattacagaggaatgcatccaaattagaatggagacgacgaatccacatggctttagacgtagctcgtggcatgaattatcttcatcatcttacccctcctatagttcatcgtgacttgaagtcttcaaatcttcttgtggacaagaactggactgtgaaggttggggactttggtctgtcacgtcttaaacatgaaacatatctagcaacaaggacgggtaaaggaacgcctcaatggatggctccagaagttcttcgcaatgaaccttcagatgagaagtctgatgtatacagttttggagtgatactatgggaactcgccacggagaaaatcccttgggataacctcaacacaatgcaggttattgcagctgtaggattcatgaatcagcggctagatatcccaaaggatgttcatccacaattggcgtctattatcgagagttgttggctcagtgagccacaatctcgtccttcattccaagagttgatggaaaaacttaaggatctgcagagacagtacgttattcaggcacaggcagcacgtagcactgcaggagatagcagccagaaggaacagtaaacacaactaacagacgtatatggttgagtttcatctgctgattgctaactgttcaagattttatggctgtcgcatgaaagttggtcggtcagagctcacaaacagcttgtgttgtcggatcctacgttcagaggctaaatgttaggcttgcagtgttaattcattacaaagaaatctgatgaagaaaacgaagctccctttattcgagtcaagttggtaatagtcatttactgccctacgtgagtcttgacatgattcttgttcgatgaattcacagtttgcattggtttgttatcttttatgaagtgaattcatcttcaaatcattgtgggttttataaggttacaacattcaaatatttgtatatttaatgagaaatttgcatccca

SEQ ID NO: 710 - DNA, 1693 bp, Solanum tuberosum
cttccctttacttgttcaaagactggagctttttcatagtattaattaattattcacctgaatgctttgatctgggtgacatcaagatttgatttttcatgtaaatttgcagtttttaggggtttagctgatctgggtcatctttatttttctccatctgagggaggaagtgaagatgaaggtagggtttttagtgtgtatatggtttgtgttgtgtggttgttgtatgggaagatttgtggtggagaagaacagcttgagagtaacatcaccagactcaatcaaagaggtgtatgagtgtgcaattggcaactttggggtaccacagtatggaggaaccatggttggtaatgttatgtacccaaaaactaatcaaaaatcatgcaagaatttctcagattttgatatcttctacaaatctaagcctggtggcatgcctgttttccttcttgttgatagaggagattgctttttcacactgaaggcttggaatgctcagcaagctggagcaggtgctattcttgttgctgatgaccgtgttgaacctttaattaccatggacacccctgaggaagaggatgcaaaggcagattatttgcaagatataactattccatcggctttaattagcaaatcacttggggatagcattaagaaggaactatctaaaggagaaatggttaacataaacctcgattggagagaggctcttccacatcctgacgatcgagtggagtacgaattttggaccaatagtaatgatgagtgtggccccaagtgtgaaagccagagagagtttgtcaaaaacttcaagggggctgcccagatacttgagcagaaaggttatacacagtttagtccccattacataacttggtattgcccggaagcgtttattttgagcaagcaatgcaagtctcagtgcatcaaccatggaagatactgtgctccagaccctgagcaggacttcagtaaaggttatgatggaaaggatgttgttttgcaaaatttacgtcaagcttgcttttttaaggttgcaaatgaaagtggaaaaccctggttgtggtgggattatgtcactgactttgcaatacggtgtccaatgaaagagaagaaatacacaaaagaatgtgctgatcaagtaatcaagtcacttggctttgacgtcaaacagattgaaaattgtgttggagatcctgaagcagatactgacaaccctgttctaaaggctgaacaggacacccagataggtaagggcgctcgtggagatgtgactatcttgccaactctcgttataaacaatagacagtacagaggtaagctggacaagggagcagtcctcaaggcaatttgttcaggttttgaggagacaaccgagcctgcaatttgtttaactgaagaaatagaaacaaatgaatgcttagaatcaaatggtgggtgctggcaggacaaggctgctaacattacagcatgccaggatactttccgtggtagagtatgtgaatgcccagtagttcagggagtaaaatttgttggtgatggttatactcactgtgaagcatctggagcattgcggtgtgaaataaacaatggaggctgttggaagggaacccaaaatggcagggcatattctgcttgcattgacgatcacacaaaggttgcaaatgtccaccaagattcaaggggatggagt

SEQ ID NO: 711 - DNA, 2851 bp, Solanum tuberosum
ggccaaattttctctttcttcccttaccccaaaagttcatctctttgctctctttccaaatcccccaaaattctagggttttcatttttctgttgaattttggatcggtgctttgttttagtttttgggtagaggttccgattcctgggttttgtggcagaattttgggggatccaattgtatattaagagaaagagatgagttttcaagatcttgaagcgggtcgaccattggggccccgtagagggtatatgaatggtaagcaagacccaactcaagctgtggcttctggaattttccagattaacactgctgtgtcgacgtttcaaaggctggtcaatacacttggaacacccaaagatacacccgagctgcgtgagaagttgcacaagacgagggtacatattgggcagttagtgaaagatacatctgcaaaacttaagcaagccagcgaaacagatcatcgtgttgaagtcagtgctagcaagaaaataacagatgctaaacttgctaaagattttcaagcagtcttgaaggagtttcaaaaggctcaaaggcttgcagctgagagagagacagcatatacaccttttgttccccaagcagttcttccttctagttatacagccagtgagatagatgtttcttcggaaaagagtccagaacaacgggctctccttgtggaatcaagaagacaagaggttttacttttggacaacgagattgcctttaatgaagcaatcatcgaagaaagagagcagggaatacaagaaatacagcaacaaattggtgaagtgaatgaaattttcaaggaccttgctgtgcttgttcacgagcaaggagctatgattgatgatattggttctaacgttgagaatgcacatgctgcgactgcacaggggagatcgcaacttgctaaagctgcaaagacccaaagatcaaattcatctctgacttgcttactcctggtgattttcggaatcgtgctcctcattgtgatcatagtacttgcagcttgagctaaagattactgggatatagaaaagggtcccgaactctgttcagatacagaagtgagtgctttgattcgaaaaaaagtgactcttgtgattcgagttctttcaataggcaccctggagtgtggctcggttgtcccaatccttggttcttctagtcatagtagacaagtcgtgtagttagggaggtgggatagcaaagattcctgttcaacttgtaaacctggtgctgtgtttgcaagatgtattgctgccatgtaatggtgggtctgtcaataacaatttatttttgtttgaggagcaatctcttatatttgccctttggaatactcttgaaccagatgacattcaattctttattgatgcttgtgtgtgtgaagttatcactaatgggatatgttgatttgtttaaaaatattagtccaagaatcattttttaaaatctccatcttacaatatattcatggctcttcaggttgctgcattgcttccttctactttctctattcccaaggaggggaaaactagtgcaactttgaaggattctagtctctttggaatctctctctctgaccatgttaaatctgattttggctcttcattcaaaatcaagagcggaagaaagtcatccctcggagctattagagccgagacaatgattgcatctcccggtgttacgaatgcccctgtgacaggaaagaaaaccttaagaaaaggttgtgtagtaatcactggagcctcttcaggactaggactagcaacagcaaaagctctggctgagacagggaaatggcatgtaattatggcatgtagggactttcttaaagctgaaagagcagcaaaatcagcagggatgcctaaagagaattacactataatgcatttagaccttgcatcgcttgacagcgtcagacaatttgtcgataactttaggagatcaggcaatcctcttgatgtattggtttgcaatgcagctgtttatcagcctaccgcgaaagagccttcgttcacagctgaaggatttgagcttagtgttgggactaaccatcttggtcatttccttctttcaagattgttgattgatgatttgaagcagtctgattacccttcaaagagactcatcattgttggttcgattacaggaaacactaacacattggctggaaatgtacctccaaaggccaacctcggggacttgaggggtttggcaagagggctcgatggacttaacagctcggccatgattgatggtggtgactttgatggtgccaaagcatacaaagacagcaaggtttgcaatatgctcactatgcaggaattccatagacgataccacgaagagactggcatcacatttgcctctctataccctggctgcatcgcaacaacagggctattcagggagcatatccccttgtttaggctccttttccctccattccagaagtttattaccaagggattcgtctccgaggcagaatctggaaagagacttgcacaggttgtaagtgatccaagtcttacaaaatcaggtgtttattggagctggaacaagaactcttcctcttttgaaaaccagttgtcagaagaagccagtgacgttgagaaagcgcgtaaagtgtgggaagtcagtgagaaactcctcgggttggcttagattttgcggattgagttcaaccatcgccaagatgaacaagaaaagggagttgatgaaggagaatttaaatcaagagtttgttttgttgtagttaaaagttgtcactttgtaaaaattttgagttatgaataaatatcactcatcctgttttcttctgaagcaaaagtgttaccaattt

SEQ ID NO: 712 - DNA, 752 bp, Raphanus sativus
ggayygaacarcawaacmcaaaggatcataagctataryttkgtwacatctttgaatytcactwaaaagttggaagaaaatgcagtcgatgaaggaaamagcttcgaacatcgcagcttctgcgaagtctggcatggacaagaccaaagccaccgtggaggaaaaggctgagaagatgacaacacgagaccctcttcacaaagagatggctacacagaagaaagaagagaggatcaatgaagctgagatgcagaagagagaagcgcgtgagcacaacgctgcaaggaaagaagcctctggagctgggacaggaactggtttgggactggggtcggccactcactcgaccactggacaagtcggacacggaactgggacccaccagatgtcggctttacctggtcacggcacgggacaaccaacggggcacgtygtggatggtacagccgcsacagaaccgataggaacgaacactggaactggtaggaccaccgctcataacacccgcgtgggcggtggcaccactgggtacggaaccggtggaggatatactggataagacgttttgtcatttgtttatatgttcttgtcaacttgtcctttgtgtgtgttcatgttttcttttttttttttggtcctacctttgtttttctcataactgtaggactttgcttttgtgtggtgtgtctttgatctgrtgacagacttgacagttgtggtttttgaataaaagtgtrtgtcaaaacttgcca

SEQ ID NO: 713 - DNA, 1169 bp, Raphanus sativus
gggatctgatgtagctgttaaagtgttttccaagcaagaatactcggaagatgttatacaatcttttagacaagaggtactgttgatgaaaagacttagacatcctaacgtcctgctctttatgggagctgttacctcrcctccacgcctgtgtatagtgtccgagttccttccacgtggaagtctctttcgcctactacagaggaatgcrtcaaaactggattggaggcggcgtatccatatggctttggacattgctcgcggtatgaattatcttcaccattgtagtccacccatcgtccatcgtgatctgaagtcgtcaaatctgctggtagacaagaactggaccgttaaagtagytgactttggtctttcgcgtatcaagcatgagacatacctaaccaccaagtccgggaagggaacgcctcaatggatggcaccagaagttcttcgaaacgagtgctgatgagaagtctgatatttacagctttggagtagtactctgggagcttgccaccgagaagatcccatgggaaackctyaacgctatgcaggtgatcggagctgtygggttcatgaaccagaggctggaaattccaaargacattgatcccttatggatcgcwttaatggagagctgttggcacagcgatacgamgctgagacccacgttccaagaactgatggataagctaagagagatgcaaagaaagtctacaatacagctccaagctactcgtgctgccttacgtgayaactcccccctcaaggacaactaaagtgaacaaaagtsgactcttttgttcctsaaagcgcgttgttcatgaaaacaaacgaaggtagagaatttgatctgttttttgagcagtwaaaaatgggtgggtttagttacaacgtggaggagacyggtctrgtgagctggggcarccacyggaattgtgggactggttcaaaaggcaggaagaagtgatgtgtttaggtcattacacaamtggccaaaaasaaaacgtatggctcagggttggttagtgtaattgtggtgattggtttttgctacttttctttggtggaggctwgaaggaagtacgtgaaagggatttattgcaaaaatgtcactttgcttgaataggtgtgcaagagtgtatacttgcatattgttattattatat

SEQ ID NO: 714 - DNA, 1832 bp, Raphanus sativus
ggacgtttctctttcttcgttccgtggcccaaagtctctgaaactttctcgacctctctctctctaatctctccctgaaaagaaccctctctttaatggatacatcgcctctccgatctcattcctcaacgttctcctcaagacttttgttgctcttcttctgtagtattcgtgcttcttctgtttcccatcgtaatccttgtaattgactcggaagctctataacttgcaccgcttcgttgaatagttgattttggatttgatataggaaaaaaccatggggaggaagtctcagcgtaagaatgtccccatggatttgtttgatagtgatgatgatacaagtagtataagctcttcctccaccctgcggtctgagaggccgaccggcatggatgaagttcaggttcacaaagatgttttgttggatcaatctctcgatgctctctatgagaaaaggagttcaacgagagagcaggctttagcctccattgttgatgctttcaacagcgacttgcagcttgagtttgtcgaaaagaagtttgccactttattgcatcagtgtttacactgcaccaagaaggggtccagcaaggagacctctttagcatcacatgttattgggttgctagcattgactgttggacttggggatcaagctcaagagattcttgaagaatccgtcactcctctttctcaggcccttaaatctggccgtgaagccttgaaaataacctcsattcttgagtgtttagcagtcrttacctttgttggtgggaccaattcggagcaaactgagagatctatgcaaataatatggcaaatgattcaccccaaactaggttctaatgttgttgcaaccaaaccttcacctgctgtgataactactgttgtctcttcctgggcgtttctgctcacaacagttgaccgatgggccctagtcccaaaatttggcaagagaccrtaacttatctctcctcactgttggaaaaggatgaccgatctgttcgtatagctgctggtgaagcgcttgctctgatatttgagtttggaaccctagagaagtttgctgccgaagccaaagagtctgctgctaatggatcggtgaaagaaggaagtgtgtcacaggaggcattgattcacatgcatggcctgaaatccaaagtcgttaatcaagttagggacctctctgcagaggcaggtggtaaaggttctgctaagaaagatctcaacacacaacgtaatttgttcaaagatcttgttgaatttcttgaggatggctacgcacctgaaacctctacaaaggttggaggagactatttacagacgacaacttggtatcagatgatacagttaaatttcttaaagcatttccttgggggtggctttatcaagcatatgcaggagaatgaattccttcatgatgtatttagtttcactccaaagaagattggtggacgaggttctactatgtctagtgaagaaaagaggatgtttaaatcgccaaactcagctctcaacaaagcaaggacgcagttcctgaacaagcagaggatgctagctaagaacatgaacgatgggcattatgcagcaacggtggagaacgaatgattgacttctcactattgattttaaagctatgcaaactttgctgctgcctttgttgttgatgattgatgtgatgtacccatagaatcacttttgctgtttcttcttatacttcttttactgtcgaatgttattactgtgacaaaccagttgttgctctcggagagccatttgaacaattgtacgtttagctgagattcagaattgaaatcgcagatttataccga

SEQ ID NO: 715 - DNA, 1195 bp, Raphanus sativus
ggtctatagactagggtacggtctcttggccttgtctttgatccacagcttgtcgtggtggatcatagtcgcggctcagattgtgtacatcaagatgagcccgaggtgtcgccggacttgggaaggttttagctggaaagcttttgaaggtctttggagctttttccggttatcggcggcgtccgccgtcatgctctgcctcgagtcgtggtattcgcagattcttgttttactcgccggacttctcaagaaccctgagcttgctttggattctttagctatatgcatgtcaatttctgcaatctcgttcatggtctccgttggattcaacgcagcagccagtgtgagagtaagcaatgagttaggagctggaaacccaagagcggctgcgttttcaacgtttgtaacracagsagtatcattattgctagcgatttttgaagccgttgtggtcatgtcrtggcgaaatgtcatcagctatgcgtttactgatagtcctgcggtggctgaggcggtttcggatttatctccctttttagccatcaccattgtcctcaatggagttcagcctgttttgtcaggtgtggctgttgggtgtggatggcaagcatttgtggcgtacgttaacattggttgttactacgttgtgggaattccgattgggttcgtacttggtttcacctatgatatgggagcaaagggaatatggacagggatgattggtggcacattaatgcaaaccataatcttagttattgttacctttagaactgattgggataaagaggtggagaaagcttcgagccgattggaccaatgggaagagagccgggagccgcttctgaagcaataaaaaatagaataccaacaattcttttttgggagagaatcacatgaaagatgccaatttaattgataaaacacatatttttcagtcgaaaaatgtatgttgctttgttgattgatgactcggaaatttatttatttattcctggaaaagaaagaaaattgtaatgagcattttcagtgtgagagtgaatatatgtattttcattaaagagagtgagttttttcaccaaattatgtttgttttgttattttatagttacgtaagaaatggggatccttttattgtattgtacacatctgattttcggtttgattaaaggtgtgattgcggtacagctttttttta

SEQ ID NO: 716 - DNA, 1096 bp, Raphanus sativus
gcaaatacgacacttcagatcgacctcgagttggtttcttggaagaccgtcgtggaagtaactgatgacaagaaggtcactaagaagattttgaaggaaggagaaggataygagcgtccgaatgaaggagcagttgtcarattgaagytgattggtaagcttcaagatggaacygagttcttgaagaaaggttatggagaagaggaggagcccttcgagtttaaaaccgatgaagaacaagttattgaagggcttgagaaaagtgttatgggcatgaagaagggtgaggtggctctcatcaccatctcaccagagtatgccttcggttcatctgaatcaaaacaggagctcgctgtgatcccacctgactccacggtctgctacgaggtcgagttggtatcctttattaaggagaaggartcttgggacatgaacacacaggaaaagatagaagctgctggcaagaagaaggaagaagggaacacgctattcaaggctggaaaatatgcaagagcttcgaaaagatacgagaggggtgtcaagtacatagagtacgattcgagtttcgatgaagaggataaaaagaaggctaaagctctgaagattgcttgtaacctgaacaatgcagcttgcaagctgaaactgaaagattacaaagaggctgcaaaactgtccacaaaggtgttggagatggacggaagcaacgtgaargcaatgtataggagggcacatgcgtacatggagacagctgatcttgatttagctgarctcgatatcaagaaagcccttgaaattgatcctgacaacaaggaggtgaagatagaatacaaaaaactgaaggagaaggtgaaggagtacaacaagaaagacgccaagttctacagcaacatgctggcgaaaatgcttgagccacataaagaagctcggaaggacacacaagcgatgagtattgacgccaaggcatgagtcgaaacacgtgagagtcactttgtgtcagaaatgaattactagttgttgttatctgtttgtaaacadtcttggtgtgtgcgactattatggatgattttgctcttataataaagcagactttgggtta

SEQ ID NO: 717 - DNA, 1036 bp, Raphanus sativus
gggacaggsagcaagagacttttgaaagatctcaacacacagcaaaagaaaactaggtaaagagagagctcttgagttgtttctttggtgtgtagatggaaacagagaagaagagcaaggagctagggcttaaccacctagggttcgtgagagttgcagcgatccaagttcttgttagcctctcaaatctctacgactacgccaaacaaaactccggtcctcttaaaccggcggtgggaaaggtggaaggygccgtcaccacmktsgtcaymcctgtctacaacaaattcaaagatgttccagatactctcctcctctttcttgatcacaaggtaggtgaagtttcgaacaagtttgataagcatgctcctccaatggctaagaaagtagtaagtcaagcaagtgtattgatccaggcgactgcagagaaggctcaaagctttgtgaaagaggctcgtaccggtggtcctaaagctgcctttaactatgctgcaactgagtacaagtacttcgttgtgaccagctcggttaaagtctgggctaaactcaaccagtacaaaccgattcatgtagtgggaaacaaagctttgcccctggctgcaaatttgtgtggtatgtacaacgatttggtgaccgacatgacaaagaggggttaccctgtggttggttatcttcctttggttcctgttgatgacattgtcaaggcttatgaaaaggaacaagatgcagcgcaaaagaaaggagatactaccactgcttctgatggaaacaaatcgttgtcgtcgtctgagtcgtcgtctgattcggacaccgattgaaacatttgtgaattttgtagtctttggagtctggcttgttgggttgggaaacttgtgtaaatgatcacagaacttggtttgtagcttttagcaagtgtttcatttcttgttggtgtaaaattgtgattcgtgtgttwtatgtgttatcaagaatctaatctattaagcaacaaacttttaagaacattagaaaaaaattatcacatttcagaaagtga

SEQ ID NO: 718 - DNA, 1132 bp, Raphanus sativus
gcttggaggagggtacattgctgtggagtttgcatcaatttggcgcggaatgggtgctactgttgatttattcttcaggaaggaacttccactaaggggmtttgatgacgaaatgagggcactygtggctagaaatcttgaaggaaggggtatcaatctgcatccacagacaagtttggctgagttgataaaaacagasgagggrataaaagtaatatcctctcatggrgaagaattcgtggcagatgttgtactatttgctacyggaagagcycctaataccaagagattgaatttagaagctgttggtgttgaacttgatcaggctggagctgtgaaggttgatgagtactcacgcactaatatacctagcatatgggctgtgggagatgctacaaaccgaattaaccttacacctgttgcgttaatggaggccacctgctttgcgaacactgtctttggtgggaagcctactaaagcagactacaccaatgtagcttgtgccgtattctgcataccaccactagctgtggtgggtctcagcgaagaagaggcagttgaaaaagcgaccggggatattttggttttcacctcaggttttaaccctatgaagaacaccatttcgggacggcaggaaaagacattaatgaagcttatagttgatgagaagactgataaggttattggagcatccatgtgcggtccagatgcagctgagatcatgcaggggattgcaattgcgctcaagtgtggagcaaccaaagcacagtttgacagcacggtcgggatacatccatcttctgcagaggaattcgtgacaatgcgcactgtgaccagacgcattgcctacaaagccaaacctaagacgagtctatgaaccgccaaaattttaaaagacaatttgcataaaacactttattagaggtcagaccgaaacatgagtttcctcactcatgttccaaataaatgttttgyataagtttttgtttgtttgttgatttacttctaaaattcagaacacacacaatttcaatttctgcttctcttgttgctagtgaaacttcgccaccaaatatatgcattatctttgggaccccattatctttgaataaaattctctcccttttggcca

SEQ ID NO: 719 - DNA, 1193 bp, Raphanus sativus
tttttcttttttcttgggaggccccacattaccagatcacgtggacgagtccacccccttggtttcttttaaccagtcctctcattccccaacgkgttgtgaagatactttctgtttagcgaagacaggcgataactccgaagcaaagagatattattaaaagacttgttggtagaaacgatcagatggagacggagaagaaaaatagcaaggagataggtctgaaacacctagggttcgtgagagtcgcggcgatccatgttctcgtcagcctctcgagcctctacgactacgcgaaacaaaactctggtcctcttaaaccggcggtggggaaagtggaaggagccgtcaccaccgtcgtcaaccctgtctacaacacattcaaagatgttccagatactctcctcctctttctagatcacaaggtcggtgaagtttcggacaagtttgataagcatgctccaacgatggctaagaaagtagcgaatcaagctaatgtgttgatccagaaggctcaatcctttgtgaaagaggctcgtaccggtggtcccagagctgcttttaactatgctgcatccgagtacaagtgtttccttgtgaacagctctgttaaagtatgggctaaactcaaccggtataaaccgattcatgcagtggggaacaaagctttgcccgtggctgcacacttgtctggtatttacaacgagttggtgacggacatgacccagatgggttaccctgtggttggttatctcccgttagttcctgttgatgacattgtcaaggcttatgaaaaggaggaaggtgcagcgcagaggaaaggagatgctgctgctgctgatggaaataaatcgtcgtctgattcggatactgattgaaaaacgcttctgtgatttaaagctgtttgttttttggttgggttttggttacttgtgtaaatgatcttattaggcactctcttttgttttcctttttgttcacagaactwggtcctggtagttttttagcaagtgtttcatttcttggtgtgtgtgacaatgtgatgcgtttaaagaatcgtattaggccctctcttgttttcctttttgttcacagaacttggtcctgtagttttttagcaagtgtttcatttctttgtggtgtgacaatgtgatacgtttctttctatgtttttataaaccaggagaaataca

SEQ ID NO: 720 - DNA, 1096 bp, Raphanus sativus
ttttacccgacagatgaagagcttcttgttcagtatctctgtcggaaagttgcaggctatcatttctctctccaagtcataggagacatcgatctctacaagttcgatccttgggatttgccaagtaaggccttgtttggggagaaggaatggtatttcttcagcccgagagaccgtaaatatccaaacgggtcgagacccaacagagtagccgggtcgggttactggaaggcgacgggtacggacaaaatcatcacgtctgacggccaccgcgtcgggattaaaaaagctctggttttctacgcgggaaaagctccaaaaggcaccaaaacgaactggatcatgcacgagtatcgcctcttcgagcattctcgtagccacggaagctccaagttggatgattgggtgttgtgtcgaatctacaagaagacgtcggggtctcagagacaacaagccgttgctccggttcaacctgaacacagcacgaacgggtcgtcgtcctcttcgtcgtctcaccacgaggacgttctcgactcgttcccggagatgaaggatcggtctttcgatcttcctcgggtgaattctctcaggacgcttctcaacgggaatttcgactgggcgagcttagccggtcttaatcccatcccggagctagctccggcgagcaacaacggtacggcggaggagggtacgacgcgtttcgagcggcggagggagaggcggagagcgggttgagaaattcgcaggtgaactcgagcgagttgactcagagtttcgggtacagctcgagcgggttgagtagtggcgggttcggaccttcgggtcagacatatgagtttaggcaatgagagatagatcatttggtttggttggtaactctcatgataatctttgagagggtagagtggtaattaatgtaaataaatagggatttatatgggcctttcaccgattcggttaggcttwggattccagaaaggcaatgggcttttgattagttttgatgggcgataaatgttataataattgttccactataccttgatggattcgtcgaattcttaaaaaataaaatggttgtttcatgtttgagatt

SEQ ID NO: 721 - DNA, 1517 bp, Raphanus sativus
gcttcaccactcctaagaaccaacctttcgtctccgacttcctctccgacacgccggtgatcaatgtcatctctctccctttcccggaaaatatctccggcatccctcccggtgtcgagagcaccgacaagctcccttccatgtcactctatgtgcccttcacgcgcgccacaaagcttctccaacctttgttcgaagaatcactcaaaaatcttccacaagtttccttcatggtctcggatggattcctctggtggacatcggaatctgcagctaagttcaagattccaagattggtcttcttcggcatgaactcttatgcctctgctgtctccatctctgckytcaracayaaactctttaccgaaccrgrcacygastatacagraccggtcactgtaccggactttccatggattcaggttaagaagtgcgagctcaaccttgatactcaaccgggtccagccgccgaactactcatggaccaaattatgtcgacaactactagtcatgggtttctagtaaatagcttctacgagcttgagacaacatttgttgattacaacaacaacaactccgaaagcccaaagtcgtggtgtattgggccattgtgtttcactgatccacctaaaccgaagcgtgctaaaccggattggattcattggttggaccagaaagsagaggaaggacgtccagtcttgtacgtggcrtttggaacacaggcagagatatcaaacaagcaactcaaggaactagctttaggcttagaagattccaaggtaaattttttatgggtcacaagaaaagacgtggaagagattattggagaaggattcaaagatagaataagaaagactgggatgatagtgagagattgggtggaccagtgggagatattgtcacatgaaagtgtcaaaggtttcttgagccattgtggatggaattcagcactagagagtatatgcgttggggtcctgttgttggcttggccgatgatggctgagcaaccactgaatgcgaaaatggtagtggaagagataaaggttggactaagagttgagacccaatatggtagtgtgcgaggattcgtaacaaaagaggaactaagccaaaaggttcaagaactaatggaaggagaaaaagggaaaacagcaagaaagaatgtaaaagaatactcaaaaatggcaaaagcagcgttgatccaagagactggttcatcttggaagaacttaaatttgcttcttgaaaagttatgtaagagtggagagacaagcgagggcaataactagcaagtatgaagactgaggactggttaacttgattaaccagtttagagcggttggtataatcaaatcaatatatccaaaatatatgtttatgatttgttttggtttactagaaccttttcattttacctggagacatcaggaaaatgtgtaccaaaagccaaaatttgtttaagcgagagaactctaagtatgagaactttttaaaaaaaaatctaatttggttccttt

SEQ ID NO: 722 - DNA, 1657 bp, Raphanus sativus
gacacacacaatcattagttttattggcaccgcaatccttccttcgtgtctggatctcaagtagtgttcttattacacaccacttcttctgcagagattttggatttgtgattctgcacgatcatggggaggaagatgcttgatgatggagaggttgacaaggcggtgggggcggaggagactcactatgattttgatttgtttgtaatcggcgcagggagcggcggkgttcgtgcagctaggttttccgctaatcatggcgctaaggttggtatctgtgagcttccctttcaccctattagctctgaggagattggtggtgttggtggaacgtgtgttattcgtggctgtgttcccaaaaagattctcgtctatggtgctacttatggtggcgaacttgaggatgctaaaaactatgggtgggaaatcaatgagaatgtggacttcacatggaagaagcttctgcaaaagaagactgatgagatattgagactgaacaatatttacaagcggttgttgtcgaatgctgctgtgaagttgtatgaaggtgaaggaagaatcgttggtcccaacgaagtggaggtgagacagatcgatggtaccaaaattagttacaccgccaagcacattttgattgccactggcagtcgggcacaaaagcccaatattcctggacatgagctggcaattacatctgatgaagctttaagcttggaagagtttcctaagcgtgctgtagtgcttggaggagggtacattgctgtggagtttgcatcaatatggcgtggaatgggtggtacagtggatttattcttcaggaaggaacttccactaaggggctttgatgatgaaatgagagcactagtggctagaaatcttgaaggaaggggtgttaatctgcatccmcaaacaagtttgactcagytgayaaaaacagacaaggggatcaaagtaatctcgtctcacggagaagaattcctggcggatgttgtactatttgctactggcagaagtcctaataccaagagattgaatttagaagctgttggtgttgaacttgatcaggctggagctgtgaaggttgatgagtactcacgcacaaacatacctagcatatgggctgtgggggatgctacaaaccggattaaccttacacctgttgcgttaatggaggccacctgctttgcgaacactgtttttggtgggaagcctactaaagcagactacagcaacgtagcatgtgctgtattttgcattccgccactagctgtagtgggtctcagcgaagaagaggcagtagaaaaagcgactggggatattctggtttcacctcaggctttaatcctatgaagaacaccatttctggacgccaggaaaggtcattgatgaagctaatagttgatgagcagactgataaagttattggagcgtccatgtgcggtccagatgcagctgagatcatgcaggggattgcaattgcgcttaagtgtggagcaaccaaagcacagtttgacagcacggttgggatacatccgtcttctgtagaggaattcgtgacaatgcgcactgtgaccagacgcattgcctacaaagcccaacccaagaggattttatgaaccgccaaaatttaaaaagacagtttgcataaaacacttta

SEQ ID NO: 723 - DNA, 1423 bp, Raphanus sativus
gcacggagctcaccgttacgatatgctcggtgtttacctccagagatcaacggtggttctgataatcacgtgtcttccgatgtcgctcctcttcgtattctcgaaaccgcttctcaacacactaggcgagccggagcaagtcgcgtcaatggcttccctcttcgtctacggtatgctccctgtgatattcgcttacgccgttaacttcccgatccagaagttcctccargcgcagagcatcgtcacgccragcgcktacatctcmgccgcggctctcgtyatccacctcgtcctctcgtgggtcgctgtgtatcgsttggggttgggtctcttggctttgtctctggttcatagcttctcgtggtggatcatcgtsggggcccagattgtttacatyaagatgagcccragatgcagaaggagttgggaagggtttagctggaaagcttttgaaggtctttgggactttttccggttatcggcagcttcggcggtkatgctctgccttgagtcgtggtactctcagattcttgttttrctcgccgggcttctcaaggacccggagattgctttggattctctcgctatatgcatgtcaatttctgcagtctcgttcatggtttccgttggattcaacgcagctgcaagtgtgagagtaagcaatgaattaggagctggaaacccaagggctgctgccttctccacagtagtgacaacaagtgtatcattcttactagcggttttcgaagccatcgtggtcatgtcttggcgtaatgtcctcagctacatgtttactgatagtcctatcgtagccgaggccgttgcggatttatccccctttttagccatcactattgtcctcaatggaatccagcctgttttgtcaggtgtggctgttggatgtggctggcaggcatttgtggcgtacgttaacattggatgttactacgtggtggggattccgatcggtttcgtacttggtttcacctatgatatgggagcaaagggtatatggacggggatgattggtggaacattaatgcaaaccataatcttagtggttgttaccttgagaactgattgggataaagaggtggagaaagcttcgagccgattggaccagtgggaagagagccgtgaacggcttctgaagcaatagaaagaarcaacaagaattttcgtrtaaaaggttttgggaatttgaggtcaagctgaaatcaattttttttgtttcccaaaatctgtgrccgagtatcacattccaattgataaatcactaatttttcaatcgaaaaatgaatgttgttttgttgttgactaatgactcgaatgtgtatcggcatttcacatgaaaaccagtccttacattggctgttcttgagagtttaatttattttaaaaaaaatcagcgaggattctatgg

SEQ ID NO: 724 - DNA, 1088 bp, Raphanus sativus
acaaaacacgaagatcataagctaccttcttgtaacattttgattttcaaaaaagaaagataagaaaatgcagtcgatgaaggaaacagcttccaacattgcagcttctgcaaagtctggcatggacaagaccaaagctaccttggaagagaaggcggaaaagatgacgacacgagacccggttcagaaacagatggccacacagaagaaagaagcaaagatcaatcaagctgagatgcagaagagagaagtgcgtgagcacaacgctgccatgaaagaagctgctggagctggaaccggaaccggaaccggtctaggtttggggtcagccactcactcaaccactggacacgtcggacatgggactaggacccaccatatgtcagctttgcctggtcacggtacgggacaagcaaccggacacgttgtggagtgaacgacctgtccagaaaaaagtaactagtcatcgtcagagctacaaggaccgttcaaaacctgaggcggatcaagacaccatggagccagagtacatggactcatcaggagatagctcagacgatagtacttatagccacgctgatcgaccaatcatacaaagtgcaatgagaaggaagcatcacagagcttggtctctctctgaggttaagaaactggtggaaggtgtgtccaaatatggagttgggaaatggtctgtgatcaaaaagcttacgttttcgtcacactcgtatcgtaccccagtggatctcaaggataaatggcgaaatctactcagagcaagcttttctcggaatcctttaaacaaaatggggaaacacgggtcgatggctattccaagtcagattctgtcacaggtaagagagcttgctcagaagaaatcacatgtttcaccggcaaggaaggctagaatggtgagggcatcatcaagacacgttgccgcggaaaatctgagatgatgacatcttttttactttttttgatttcatagacttaattctaaggtagcttttgtggtctaaccgggcctataaaccggtgatggaacagacgaatatgaacggttttctaatatattggccaaatgtttaatc

SEQ ID NO: 725 - DNA, 661 bp, Raphanus sativus
ggaagaaagaacttcctactagtacaatataccacgtaaaattaacaccgatcgaaacaaaaaggaaaaaagaatcgtaacaagaaagaatcaacatggcgagtttattagataaagcaaaagatttcgtggctgataaactcgccggggttcctaaaccggagggttcggttacggacgtcgaccttaaagacgtgaacggtgactccgtcgagtacttagccaaagtgtcagtcaccaatccttacagtcacgcgattccgatctgcgagatcaatttcactatccacagcgctggccgggaaattggaaaggggaagataccggaccctggttcactgaaagcaaaggacatgacggttcttgatgttccgatggtggtaccgtatagaatactgctcaacttggctcgagacgttggtgcggactgggacattgactatttactcgaaataggtctcaccattgatcttcctgttgtcggggattttactatccctattaccagcaagggcgaaatcaaactccctacttttaaagacttcttctgaatcaactttgcgcaattgaaaaaaaaaatcaaatatcgtttgtaatggtgatatgatgtaactgataactgtggtttgcctataaaatcaaatattgtttcttatatata

SEQ ID NO: 726 - DNA, 697 bp, Raphanus sativus
ggracaacaaaacacgaagatcataagctaccttcttgtaacattttgattttcaccaagaaagaaagataagaaaatgcagtcgatgaaggaaacagcttccaacattgcagcttctgcaaagtctggcatggacaagaccaaagctaccttggaggagaaggcggaaaagatgacgacacgagacccggttcagaaacagatggccacacagaagaaagaagcaaagatcaatcaagctgagatgcagaagagagaagtgcgtgagcacaacgctgccatgaaagaagctgctcgagctggaactggaaccggtctaggtttgaggtcagccactcactcaaccactggacacgtcggacatgggactgggacccaccagatgtcagctttgcctggtcacggaacgggacaagcaaccggacacgttgtggagggaacgaccttgaccaaaccgatcggcacaaacactggaactggtcggaccactgctcataacacccacgtcggtggtggcaccactgggtacggaactggtggaggatacactggataaggcgatttctcatatgcttttttgtatgcttttttgtgttcatattgcttttcgggtcctacctttgttttttctcgtaagaactttttattattgttttaagttaatccaataattaattaaatttaactgcttaaacca

SEQ ID NO: 727 - DNA, 1277 bp, Raphanus sativus
ggwggttcaaaagttcaacaaaatatcaagaaagtgaagatatattattatactagaggaagataaatattaaaaaatgggtattcaagaacttgacccgttagcccagctaagcttaccaccgggtttccggttttacccgacggacgaagagctgatggttgattatctatgcagaaaagccgccggtcacgacttctctctccagctcatagccgagattgatctctacaaattcgacgcgtgggttttaccaagcaaggcgttattcggggagaaagaatggtatttcttcagccctagggataggaagtatccgaatgggtcgaggcccaacagggttgctggatcgggttattggaaagccaccggcacggataaggttatctcgaccgagggaagaagagtaggtatcaagaaagctttggtgttttacattggaaaagcaccaaaaggcaccaaaactaattggatcatgcatgagtaccgtcttatcgaaccctctcgcagaaatggaagcaccaagcttgatgattgggtcctatgccgaatatacaagaagcaatcaagcgcgcaagacagcttacggtatctatgacaastrcagtgatatagcaacatggttcgtcgacttcaacttcatctcaccattacgacgacgttcttgagtccttgcatgagatagacaaccgaagtttgggttacgccgccggttcatcaaacgcggttcctcattatagtcatagaccggctttaaccgaacagaaaaccgggtttyttaatttagcaagggagccaagttatgactggactaattttggtggacacaacacggtcccggaacttagacggagtcataacgttccaagcctccgttacggcgacggtggtrgttatttacacggtgtgaagacaaacgaagaagaagataagacgaagcaacaacatgctgaggggattcctcggtttaataactcaggcgtgttggctcctgatcagggtttccatgttgacccggttawcgggttcgggtactcgggtcaacaacctggtggtttcgggtttatgtgattgtgtaatggtgacgcaataacaaaaaagaaacatawttttttttgtgcgaatcagattaattgattaatagcgtgtaattggaaatcatgggggttagcttaggttccacttgtatattggtcgtcatttgtcctcaaagatacatttttgcaaactttttagctggattctcatcatttgtattaaactattaattaattgga

SEQ ID NO: 728 - DNA, 1195 bp, Raphanus sativus
ggagcagagagagaagaagaagcayacgctccwgagraacagaggaayacatctctcaaatggcgacaattagagtcccagacgargtcccttctccagctcaggattctgaaactctcaayaaakctttycgcggatggggaacagacgagaaggctatcatacgcgttttaggtaaaagaaacgagagccagagaaagagaatcagggagagttacagagagatttacggcaaagatcttatcgatgatctctcctctgaactctctggtgatttcaagaaagctgtgattctgtggacgaaagatccagcagagagagacgcaaggcttgcttacaaagtcttgaatgagaaaaagaaaaccatagagaagctsaagatcatcgtggagatcgcttgcacaarttctcctraccatttgattgctgtgaggaaagcttattgttctctctacgactcatcccttgaagaacacattgcttcctctgtgccctttcctcttgcaaagttgctggtgacattagcaacttcattcagatatgataaagagaaggttgacaaagaagtagctacaatagaggcgggtatgctgcatgaagcgataacaaagaagcagttagatcatgatcatgtcctttacataataggaactcgcagtatctaccagctcagagcaacttttgctgcttacaagcagagttatggaaacacattagataaggatgttgatggatgtccaggagatgctgatctgagaagtytattgcagatggtaatcttgtgcattgagttccctgagaaacactttgcaaaggttgtacatgattctattgaggggtttggaacagatgaagattcgttgacgagagcgattgtgatgcgtgcagagattgatctgatgaaagtaagaggagagtatttcaatatgtataattcaagcatggataacgctatcattggtgatgtttctggtgactacaaggacttcctcatgactctacttggttccaaaatctgatctttgttttatattatttgcttggcttgtgatttgtgacttgtatcaaaacttctcgttccaattctgatttgaaaatttgttataatcaaaacwactcttgattctgaatttgtatrattgtrtgctaaacaattaagcttgtggctcatgtgatgttctttaaaagaatctac

SEQ ID NO: 729 - DNA, 2415 bp, Oryza sativa
atggcggtggcggcgatggagctaccggcggtccgagcctacgacgccctggggatcaacgagacgtccgtcaaatccatgccgttcgaaaacctggccacgctgatgcagtctccggcgacgctccaggccaccaaggcggtgctcgaccggttcgagaaactcttgcctcttctttcatcgccggtcataaacatcgatcacctcctgaaacaccttggatctccaaagaagaagaagacaccaccacctgctgctgctgctagcgcgtctcgatactcgctgagggtagtcctctgctcctacatgatcctggctcatccgggtgcagtgttgagtggacaaggggagaaggagaagctacttatggattcagcaggaagctttgtcaaggagtttgagctattggttaagactgtgcttgagaagcaatcgactgatgctgctgccggtcagaaaatgttcagtgctcagctggccgatttcgatagagcatggtgcgcttacctctactgctttgtggtgtggaaactgaaggatgcgaaatcgctggaggacgatcttgtccgggctgcgtgcaagcttgagctgtcgatgatgcagacgtgcaagctaagttcagatgggcagtcacataatggcctctctcatgatatgaaggcgattcagaaacaggttgctgatgatcagaagctgttacgagagaaggttcatcaactgagtggcgatgcaggcatcgagcggatgaactctgctctttcggacacaaggtcaaagttctttgaggcgaaggagaacggaaacccattagctgcatcagttgcaaacgtatctactcctttgagcattggttcgtctggatcgagcttcactgcccaatctttgcctggagctgcttcatcgccaagcagttcatctctgatgaaacagccgacggacaatgagcaaatgctcaatgagatgcttcacgaggacgatgtttcttttggtggcaactctgataacgtcagttccgcggagaaggagtttcaggccaaagtgaaatcgacgatggagaaagcgttttgggatctggttactgattcgatgaaaggggacaaaccagattatacccaactaattaacctcgtgaaggaagtcagggattcattacatgagttggcttccaaggagttgaaggaggaaatcctcgagaacattgacctcgaaattttgtcacaggtgctcgagtcaggctcccaggacacgcgatatctggggcagattatgcactactccctggatatgatcaggaaactatctgcccctgcaaaggaagatgacatgaagaggagtcatgagaaattattgaacgagttggctgcaagttccgaagttaatgacaatggcatcagctcctttgtcattgctgtcatcaagggcctgcgtttcactctcgaagaaataaagcaactgcaatctgaagttagcaaggctcgcatccagctcatgcaaccaatcataaaaggctctgccggagtggagtacctgcagaaggctttcgcggatcgctatggacctcctgctaatgcatcagcgtctctccctataactaagcagtgggtttcggcaacgaagagcatcgtggaacaagagtggagctcacatttggagtctctccaagctttgccagcagatcatgctcaacgcgttgttgttccggcacttcgagctggtcacggtgctccaatggctcaggcttcttcgtccgcagctagcggttctggtctcccagaatgcaagggtgagaagatcgacaagctgacaagggttggcttgttgcaacttatcagcaatgtggagggcctgaacatgcagtcaacccctgagaccttccaaattaatctgccgaggttgagggctgtgcaagatcagtttcagaaggtgattgtgatcgcgacgagcattctcgtcctgcatcaagttctggtgtcgaaggtcgctgctccggagctgcagaacgccatctcggagctctacgacgctctcgtgaagctcctcgacagcaaccccgacgcttcgacggaggagatcgtggaggcgatggcgagctctctggcgacggtcggctctctctctctgccggagaagcaggctcaggccacggcggagctcgcgaccaagatgctcctcaagagcctccaggccggcgacgtcgtcttcggcaaggtgtcccgtacggtctactgcgcgttccgcggcgtcgtcctcggcggcggcggcgtcaagggcaagaagctggccgaagcgccgctgcgacgcctcgccgcggcgaagctcgccgacagggttgtcaaggccggggagatgctgataaatatggcagtcatatcagagaaggtccatggacaatggtacaaggcgcttgccttgtga

SEQ ID NO: 730 - DNA, 2626 bp, Oryza sativa
aaaaaaaaaaaaaacacatggagccatggacacgttgctcatgctgcttaactgaatcaggttcccttccctctgcttgcttcacgaactcgcggaaatcccgtcccctcccaaaatctcaccaacgagtccaccccaaatccatccacgaatctcttcctcactccaactgcctccctccgccgtcaaaatccaatctttcctctcacctccgccgctttcggcacgccccttcaaccccaagatcgatactctctccaccaatccgatccaatccgcagctgggttccacgaattgcaaaggtctaggcgcggattggagcatggggctccgatcccccaactcgatgctgtggctagtactactggtgtgggcggcgctgctgtgcggtagctgccatgggaggttcgtggtggagaagaacagcctcaaggtgacgtcgcccagcgacatgaagggcacctacgagtgcgccattggcaacttcggcgtgccccagtacggcggcaccatggtcggcgtcgtcgcctaccccaaggccaacaagaaggcctgcaagagcttcgacgattttgacatctcctacaaggccaaaccgggctcactccccaccttcctcctcgtcgataggggagattgctttttcacaaagaaggcatggaatgcacaaaacgcaggagcagcagccatccttgttgctgatgacaagactgaacccctgattacaatggacacgcctgaagagagtggaaatacagactatttagagaatatcaccattccttctgcgctgataaccaagagctttggggacaagctcaagaaagcaattgataatggtgacatggttaatgtgaatttggattggagggagtccctgcctcaccctgatgagcgtgttgagtacgaattttggactaacagtaatgatgagtgtggccctaaatgtgatagccagattgattttgtcaagagcttcaaaggagcagcacaggtacttgagaagaagggatacacacagttcactcctcattacattacctggtattgcccagattccttcattctaagcaagcagtgcaagtcccagtgtatcaaccatgggagatattgtgcacctgacccggaacaggatttcagcaaagggtatgatgggaaagatgtggtagtccagaatttacgtcaagtctgtgtttataaagttgctaaggagcatggaaaaccttggctgtggtgggactacgtgacagattttgcaatccggtgcccaatgaaggaaaagaagtacaccaaggaatgcgctgatggagttatcaagtcacttggtcttgatcacaaagccatagataagtgcattgctgatccagatgctgataaagaaaatcctgtgctgaaagctgaacaggatgcacagattggcaagggctctcgtggtgatgttaccatcttaccgactcttgtaatcaacaatagacaatacagagggaaacttgataaaggagcggttcttaaggcaatttgtgctggttttcgagaaaccactgaaccagctgtttgcttgagtgaagatatacaaacaaatgagtgcttggagaacaatggtggctgttggcaagacaaggctgctaacatctctgcatgcaaggacacttttcgtggaagagtttgtgaatgtccagttgtgaaaggtgttaaatttgttggtgatggctacactcactgtgaagcttcgggatctggccattgtgaaattaacaatggagggtgctggaaggattccaggcatggccggacatattctgcctgcacgaatgatggttgtaaatgtccggatgggttcaaaggtgatggagtccacaaatgcgaagatattgatgaatgcaaggaaaggactgcatgccagtgcaaggaatgtaaatgcaagaacacatggggaagctatgagtgcggttgcagtggcggcttgctttatatgaaggagcatgatacatgcataagcaaaaatgcagcaacagaggtaggatggaacttcttgtgggtgatcttctttggcctagtggtagccggcattgcaggatacgcagtatacaagtacaggatccggaggtacatggattcagagatccgcgccatcatggcccagtacatgcccctggacaaccaaggagatgttcccaatcattctcaccatatcgagctatgaaaagagtgaggatagcatgcaacttccccccatgttgcccaaatgggatgagaagaggtgaacaactcctggagatcatgacacagcctgacgatatgtgtagtagtatcactctgacgatcttatgtttagcaaatttagcccatgtaaatttctggattatcctgtggccgcataatttcaatcgtacctggctgctttgctcccatatagcgctggggaaatatggagattgcaaaattaggcaagtttgtgatctcgaggaagaacactagtatggcatttcccaccaaaaaagactagtttggaaagcatgaattttgtatagaattttcgtgtgaatcagttttgcttggttcttgcggaaaaagaaaaatcaggcattccatacatgttggtggaaaaggatgcccttcacaagc

SEQ ID NO: 731 - DNA, 1073 bp, Oryza sativa
ccttcccgttgggctcgcgcggcgccgtcccccctctctctctctctctctctctctctctctacactgctcacgcctctctctctctctgctcccaaatctgcgtgggagagagagagagagagaaatccagtggggggagggattggtctctggaggggatctagcagcagcagcagcagcagccatgaacatcttcaagaagaaggtcgaccccaaagaggctctcaggaccagcaagagggagatgtcagttgctacacggggagttgagagagagattggctccctgcaaatggaggagaagaaactagttgctgagattaagaaaactgctaagacaggaaatgaggctgcgaccaaaatcctagctcggcaacttgtgaggcttaggcaacaaattgtcaatttgcaaggcacgcgggcacaaatacgtggagttgctactcatacacaggcaatgtacgcaggcacttcaatatctgcaggaatgaaaggtgcaagcaaagcaatggcagcaatgaataagcaaatggaaccaacaaaacagatcaaggttatgagagaattccagaaacaatcaaatcagttggacatgacgcttgaaatgatgtccgatgctatagatgaaacacttgataaggacgaggcagaagaggaaacagaagaacttactaaccaggttcttgatgagattggtgttgatgtggcttctcagctgtcttcagctcctaaaggtcgtattgcggcgagcaacaggaaagctgagagcaaccaagcacgaaatgccgctccccccagaaataacgtggagcctgaatcctctgctgaagttgacgacctggagaggagactggcttcacttcgccgcatctgagcagctgataaatatatagtgcatctataattctatatgtaaatttgtttcactcaacatagcttgtctgaatatgtgcgagtagagtattgtaggcaaacaacaagatttaaataacataattgaaccttcggattttctatggaaggatgagcatttgtccaattttggaagatatgggaaaactcttttgatt

SEQ ID NO: 732 - DNA, 2576 bp, Oryza sativa
atggacacgttgctcatgctgcttaactgaatctgcttgctttgcctgcttcgttacacaagaactcgcggaaatcccgtcccctcccaaaatctcaccaccgactccaaatccatccacgaatctcttcctcactccaactgcctccccccgccgtcaaaatccaatctttcctctccactccgccgctttcggcacgccctttcaaccccaagatcgatcctaccccccaccaatccgatccaatccgcagctgggttccacgaattgcaaaggtctaggcgtggattggagcatggcgctccgatcccccaactcgatgctgtggttagcactactggtgtgggccgcgctgctgtgcggtagctgccatgggaggttcgtggtggagaagaacagcctcaaggtgacgtcgcccagcgacatgaagggcacctacgagtgcgccattggcaacttcggcgtgccccagtacggcggcaccatggtcggcgtcgtcgcctaccccaaggccaacaagaaggcctgcaagagcttcgacgatttcgacatctcctacaaggccaaacccgggtcactccccaccttcctcctcgtcgacaggggagattgctttttcacaaagaaggcatggaatgcacaaaacgctggagcagcagccatccttgttgctgatgacaagacggaacccctgattacaatggacactcctgaagagagtggaaatacagactatttagagaatatcaccattccttctgcgctgataaccaagagctttggggacaaactcaagaaagcaattgataatggtgacatggttaatgtgaatttggattggagggagtccctgcctcaccctgatgagcgtgttgagtatgaattttggactaacagtaatgatgaatgtggccctaaatgtgatagccagattgagtttgtcaagagcttcaaaggagcagcacaggtacttgagaagaagggatacacacagttcactcctcattacattacctggtattgcccagattccttcattctaagcaagcaatgcaagtcccagtgtatcaaccatgggagatattgtgcacctgacccggaacaggatttcagcaaagggtatgatgggaaagatgtggtagtccagaatttacgtcaagtctgtgtttataaagttgctaaggagcatggaaaaccttggctgtggtgggactacgtgacagattttgcaatccggtgcccaatgaaggaaaagaagtacaccaaggaatgcgctgatggagttatcaagtcacttggtcttgatcacaaagccatagataagtgcattggtgatccagatgctgataaagaaaatcctgtgctgaaagctgaacaggatgcacagattggcaagggctctcgtggtgatgttaccatcttaccgactcttgtaatcaacaatagacaatacagagggaaacttgataaaggagcggttcttaaggcaatttgtgctggttttcgagaaaccactgaaccagctgtttgcttgagtgaagatatacaaacaaatgagtgcttggagaacaatggtggctgttggcaagacaaggctgctaacatctctgcatgcaaggacacttttcgtggaagagtttgtgaatgtccagttgtaaaaggtgttaaatttgttggtgatggctacactcactgtgaagcttcgggatctggccgttgtgaaattaacaatggagggtgctggaaggattccaggcatggccggacatattctgcctgcacgaatgatggttgtaaatgtccggatgggttcaaaggtgatggagtccacaaatgcgaagatattgatgaatgcaaggaaaggactgcatgccagtgcaaggaatgcaaatgcaagaacacatggggaagctatgaatgcggttgcagtggcggcttgctttatatgaaggagcatgatacatgcataagcaaaaatgcagcaacagaggtaggatggaacttcttgtgggtgatcttctttggcctagtggtagcaggcattgcaggatacgcagtatacaaatacaggatccggaggtacatggattcagagatccgcgccatcatggcccagtacatgcccctggacaaccaaggagatgttcccaatcattctcaccatatcgagctatgaaaagagggaggaaaacatgcaacttccccccatgttgctcaaatgggatgagaagaggtgaaaaactggagatcatgagctgcaaatgaacacacagcctgacgatatgtgtggtagtatcactctgaggatcttatgtttagcaaatttagcccattgtaaatttctggattatcctgtggccgcatagtttcaaatcgtacctggctgctttgctcccatatagcgctggggaaatatggagattgcaaaattaggcaagtttgtgatctcgaggaagaacacaagtatggcattccccacccaaaaagacctgtttggaaagcatgaattttgtatagaattttcgtgtgaatcagttttgcttggttcttgcggaaaaagaaaaatctggcattcc

SEQ ID NO: 733 - DNA, 3645 bp, Oryza sativa
taagagagactcagctcccttccctccactgtttgttcaaatcttttcacttcttcttggctgttttctctttgtttttttgagggggtttggtggggttttttggtttgagttttgaaggggttttcagtttgtttccttggtgatttgttttgttttcttctgggtgtatttttctcactccttttttttttcctctcttcaaaatggttgagaaaaatacttgcatctgtgtgagctaagctagatttaccaagttactatcatttttcccccttgtgtttgcactggaagtagtactattagtatttattctttcctttttactagaactttaagcaacttgactagtgatgactcttgcagtgaggtttttcttctttcctagtgtttcccctctctagctcctcttgtttaagacctctacaagcttatgtctccgctttttgaagtttccacctgatgtcttcctaaaatatgcttcttgttttgtacatcaaacgaacaggcatagtgcacttaggaaaaaaaaacttactcttttttctctgtagttttcttgctagtctcttctctgctcttgttcttggtttgaaagttttgagctcgttttaactttacatcgtccttcatcttgtgatctgtactcgtagttctctactccacctttttttaacctcttttacccacacatcttcaaggtaccccaaatgtgaaaataaactggtgtatagtacttcaaagattggatttttccgggctgcactttatatgtggcgtatatgcaaaatcctaaaaagaaatagcccgtgattcctgagattccatgtttctttgctctccattattagcagataagagattcttgtgcaaagctccaaaagatgctactgtttggtcctagatattgttcagtgaggctatttcccacatcccacatttctcttttattaatatattttcgtttttcctgagattttctctacctagacacgtaatgaactgcatctttttttgtcagtttctttttgttgtactactactagctgtgctcttgtgactgtgagagacaagatttcttgggaggaggataaggtcaaacaagaaatccctaggggtgcctttgtaaatttgttttaaaaatcttccgaacgttgagaaacattaggtggtgagatcgaaaatgtagtactgaatggacagtggaagccataagtatgaaatttatgaggtaccccaagccgaggcctgtgtgtctcattaaatatggcctgtgaaacttgcttccatgcttcagataactagccatatttcatttcaactactagtagtactgcaaaatttcttttgtgatccatgcagtgccatatacccctggagatggtagtagctcatttccttggctgatagatctagtttgtgtagctgagggttacattgcttttgtctcacttttgatagaaccaagaaaaagagtgcgcaaaagcagggccatgcttttgcctattctctttggcctgccctcctccctcccttttatttttttctcttttgaacaggaaaagaggcccctaaaccgttgcaattttgcctttaaccccaaatgctgttgagggctagccgcatgaccagccaactggtaggtgcaccacagtatggcatgcttaaattgcatcaggccaactaactgcccttgattgcaagggagattgttgatgctacttaaatgtgtcaacgttgacacctcaacacacaaaagttaccatcttttaacgggttaatctggtatgaacccctggaattctagcacggtgactttcagcaggcaatgcatgtgcttcttgcagtttatgttcacgcattgtttgtacaccctggaagcttttactgcataaatttcatagcatgcaatgtttacctgtacatgttcatgtgatgcaaccaaaccatcatggtcacaccaagtttgtgaaatgttggcaggtaccagaggctgaccaagcattcgattgccattgatggatcccggctgtccccgttgggctggagtggcctatcatgggcgattggaatcctcattgcggctccgatcctcacccaggctgcacaccaccttgaccgtggccagtatcagtcgctcatcctcattgccgcgacatcgtttggctcattcttctgcctcctcactggcttcttcaagacagtctgggtgttcctcttctacatcctgttcattggtgcatccatcattgttgctgaggctgtgcatacacgcaatcttggactcatgatccgtggccttgcagcacatgactctggcaagcaccttgtccttcgccgtcgtgctgctgccagtcagctcaccctgtattgcactgccattggtggcattggggctgcgctcatggctgctttcatgtaccacatgcttcggcgcactgaccagctcacaggcctttgggtcgtctccatcttcagtggccttatctggttcattggtatctgccatggtctcttcacaaaccgacccagcagctcatcgcccaccacagcatttgagcctaacttcttcaccaagctcagctacagcatgacccttgtgcgatacccacaggccatcggaagcttggttgcagtgttcctttcatctttcgccacaatgtgcatcttcaccagtggcacattgtatgctattggtggtgtttgcatcaagccagtccttgtgctcgtgctctggatactctacttcctgttcccgttgatctcacttccgctgctgcacccaatccagatcatcatccgtgctgatgctgttcgcatgcagctgcttgggttcatcatctgcctatttgtgtctggtgctggtttctacttcaagagccacaggtggagagccgctcacatcattgtgatcgctcttgtccagagcacagccaatggtgtgctgtactcatttggtcgcattctgctgctcgatgcctcgccaccagggaaggagggtgcttttgcggtgtggtatgcatttgtacgctgcattggtgctatgattggcttcgctgctgcatccgctgggcctgggcgtgctggaggatcgtttgctgctgcgttcctaggcagcttcctcggcatcattgttctgatctttggtaatgtgagcaacatcggggcgctgaaggctgctgggcatctgaagggaatggaagacgagaagaggctgggcatggagaaaggggaaggcatgagtgcggttgccgattccggcgagggaagggggagggtatgatgatgattaaatgggcttgtgggaaggaaagattggaaaattgctgtggaggttgtgtttgtgagagggatttgttcttctttcttgtttctttcttgttcatgtttcagtgacactgttaattcggtgctttgccccccttggatgcatgatgatgatgacatagtggtagaggaagtgtgctagttgttaatgtgttattctttgcttggaagacaattgtaactgatgatatggttctttgttcatcgccaccgaaattctctctggcagtcatgcttcgtggttgcttttctgttgaaaatgtgattgtcaaagtgaaataaaacccttatataatatttctattgcattgtgcaaac

SEQ ID NO: 734 - DNA, 976 bp, Oryza sativa
gcaattttgcaaccgcgtcgtctcgtctcgtcgaggagaggatagagaatcgaatccatcgccgcctagggtttccttccttgtcaatcgcgcggccgcggcgatgaccacggcggcgcggccgacctgggctccggccaagggcggcaacgagcagggcggcacccgcatcttcgggccctcgcagaagtactcctcccgcgacctcgccgcccacaccaccctcaagcccaggaaagaaggacaacatacccaagaagagttacagaagaggaatctcagggacgaacttgaggagcgtgagaggaagcactactcgtcaaaggacaagtcctatgctgaggagagagataggcggaaaagcacaagcctactcctagaaggttcaaggagagaggctgaggataagatagttcctagagaaatcgatgcagatgattctgatgtggaacccagaagtgatgatgaaagtgatgaggatgatgacgacgatgatgacactgaagctctaatggcagagcttgaaagaatcaagaaagaaagagctgaagaaaaccttagaaaggaacgccaacaagcagaagaggaggctaagatgaaggaagctgaactgatgcggggaaaccccctgatcaatattaacaacgccggatccttcaatgttaagagaaggtgggatgatgatgttgtattcaagaaccaggctcgtggagagaccaagacaccgaaacgtttcatcaacgacactatcagaagtgatttccaccgtaagtttctgcagaggtacatgaagtgatgctgccgttgtacgctgttccctggccttcacggcctgcctgtctctgtctgagatcgctgtgtttctgtttctgtaatttgagtggaagatctatatatgacacaactgtaacatctgcttaatctggatggcacatttttccactaaaaatggaaaaaaaatctatgcttgtgtatt

SEQ ID NO: 735 - DNA, 1763 bp, Oryza sativa
agcagtgaagcgtacagccgagctaccaccactctccggcgccggcgagcggcggacacggcgacggcgatgggtcgcctccgccgcggcggggtcggtctcctgcgtggtgccgtggtgctcgcgtcccttctcctcgtcgtctccggcgaagtcatcttcgaggagcgattcgatgatgattggggaagcagatgggtgaaatctgactggaaaaagagcgaagggaaagccgggacattcaaacatacagcagggagctattctggagatcctgacgatagaggtatacaaacaacctcggatgctaagcattttgctatatcggccaagttcccagaattcagtaacaagaaccggacattggtggttcagtattcgataaagattgagcaggatattgaatgtggtggtgcttatatcaagcttatgtctggctatgtgaatcagaagaaatttggcggtgacactccttatagcttcatgtttgggcctgatatatgtggtgatcagacaaagaaactccatctgatactgtcttaccaagggcaaaactaccctataaagaaagatctgaaatgtgaaactgacaagttgacacatttttacacattcattcttaggccagatgcctcttatagtctacttgttgataaccgggagagagaatttggtagtatgtacactgactgggacatcctccctcctcgcaagatcaaagaatctaatgcgaagaagccaaaagattgggatgacagggaatatattgaagatcctgatgaagttaaaccagagggctatgactctattcctaaagagattcctgatccaaaggacaaaaagcctgagtcatgggatgatgatgatgatggtgtatggaagcctagaatgataccgaatccagaatacaagggacgttggaaacgcaagaaaattaagaaccctaactacaagggaaaatggaagatcccatggattgataatccagaatttgaggacgacccagacctatatgtgctgaaacctttgcagtatgtgggaattgaggtttggcaggtgaaagctggttcagtttttgacaacattttgatttgtgacgacccggagtatgcaagaagtgttgttgatgaagttagggctgcaaataaagaggctgaaaaggaggccttcgaggaggctgaaaagcggaggaaggctagagaagacgaggaggctcggcgtgcacgagaggaaggagagaaacgaagaagagacagggatcggcaccgaggcagggaccgttacagggatagatatagaggtcatcatcgtaggtatgactaccatgacgagctatgaggtctccagattatcccattctttcaaggaacttcaggaagttagtgttgcccatcgactatttcatcacccaattgatgattgtaccaataaaatagaacatgttatttcgaggacagaacaaagctttatttcaggtgtggatagcacactacaacacgaactgatgctgttcacctgaaaccaagtaacaaactgaagatgtgaaagctagaacgtacatttttgggcagtaacaatatgctagcgaagaggacgatatgtttccatcttccagtaatatttctccttattagtgccttagaacatagaaaataaatcactctaggttgtgaaatataaactgtactttcattgtacttcagttatatatatctggcagtgtgtgttactaatgttcagagagtaatgttttcctttcttct

SEQ ID NO: 736 - DNA, 572 bp, Oryza sativa
gcacccgaagaagaacaaaccgcctccaaaaatctagggtttccacccgcgcgcgacgcgattcaggtgtagcagcagcggcagagggtgatggcggcggcggcgccggcggacgcgaaggcggaggcggccaagatggacctcctcgaggacgacgacgagttcgaggagtttgagatcgaccaagaatgggatgacaaggaggatggtgatgaggccatccagcaatgggaggatgattgggatgatgacgacgtcaatgacgacttctcgcttcagctgaggaaggagctggaggaatgcaacacccagaagatctgaactacttttttttcccagttatgtttagctgtagcacctatgctgggtcaggcacttttgtaccctttgtgccccattgctttctcaacctgcaatgttcctactatactcctacttgtgtgctgaaacctgcgatcaaatttaatttgtgaaagggttaaaaccaagttggtggaaaaaatatggttctctattgttggtaacttcgagttcgaaaatcggggctaataagcgttgtccctgttggtcaa

SEQ ID NO: 737 - DNA, 2141 bp, Oryza sativa
cttccactccactccaccagaccggccaccacttgcccactccctcgctactactagtactagtcctacactatacgctcccggatggcggacgccgctggcatcgccaccgtcctcgccgccgacggcagggacttcctcctccgcaactccgccgaccaggtgaagatcagcagcatcgaggcaagcaccgttgccctctacttctcggcctcatggtgcccaccatgcaggcgcttcacgcctaagcttattgaagcatacaatgagctggtctcccagggaaagaacttcgaggttgtctttgtttcaggggataaggatcaagaggcattcgatgcatactttgcaaagatgccatggttggcagtccctttctcggactccgaatgccgtgccaaactcaataagcgctttaaggtgagaggcattccacacctcgtcatccttaatgcaacatctggtgaagtttatacggaagatggagttgagcttgtgactgtgcatggtacagaagcttacccttttacaacagagaggatcaatgaattgaaggaacaggaaaaggcagctaaggataatcaaactgttcaaagtgtgcttggtacacccacccgcgactacttactttcgaacaagggagatagggtacccatctctgaccttgagggcaagtacgttggtttgtgctttgtggtgaatggctatggcccagtagtccaatttacctcattgcttgctaaattttatgagaaactcaaagaagtaggggagaaatttgaagttgtagctgtatccttggacagtgatgaggaattatccaatgagagttttgcaggcatgccttggcttgccatccctcaggaagacaagatgggtgagaagctggctcgttattttgagcttagaggcctgcctacacttgtcctgattggtcctgatgggaagacactgaacaacaatgttgctgacataattgatgagcatggtcaagatgcatgggaagggtttcctttcactgcagagaagatggaaattcttgctgagaaggcaaaggctaaagcagagttacagaccttggagtcccttctggtcattggtgatttggactttgtgcttggaaaagatggagcaaaggttcctgtatcagaacttgttgggaagactgtcctcctctacttctcagctaaatggtgcggaccatgccgagccttcctgcctaaacttgtcgacgagtacaacaagatcaaggagaagcacaacgacttcgagatcatcttcatctccagcgatcgagaccagagctcctacgacgagttcttctccggcatgccatggctcgctcttcccctgggtgacgagaggaagcagcacctgagcaagaccttcagagtccgcgggatcccttcgctcgtcgccatcggcgccgacgggaggacggtggccagggacgccaagaccccgctgacggcccacggcgccgacgcgttcccgttcacggaggagaggctcctggagatggagaggaagatcgacgagatggcgaaggggtggcccgggaagctgaagcacgagctgcacgatgagcatgagctcgtgctgactcgctgcaccacgtatggctgtgatggatgcgacgagatgggcagctcgtggtcgtacaggtgcagggagtgtgacttcgacctgcaccccaagtgcgcgctggggaaggaggaggagaagaagggcgatgacgaggctgaggctgaggctgacccagcatgcgagggaggcgtttgcaggaaggcctaaaagagacttgttcttccactggttatctactgctgatttaagcgtgcctggatgtttggatgtgaaattagagaattatgtagtgagtaataaatatggttttgtttacaaagtagtggtattggggttgctggtacattggtatttgtgttgatgaacattagttgagaccagagctttggattattcattattatgtgcaaaccaaaaccatatgtaagtatgagtccggattggtaattgggtatcttgaatcatgttgtgagtaatagatcttagagcagtcagaaatctatctatattaacttattaaagaaatagaaaaaggagcctccacgttcgctctc

SEQ ID NO: 738 - DNA, 1736 bp, Oryza sativa
cattgcatcggaatgcttgcagctttaccgagccaccggagtagcctcgtcttctccggcgagccaccggcgatgggaagtcgcagcggcggccgccaccgactcttcctccgattcatcgccctctggtcgctgctcctcatcgccgccggggaggtcatcttcgaggagcgcttcgaagatggttgggagtcccgctgggtgaagtctgattggaaaaggagcgaagggaaagctggaacgttcaaacacacggcaggaagatattctggagatcctgatgacaaaggtatacagacaacgttggacgccaggcattttgctatatcggccaagatccccgaattcagtaacaagggccgtacattggtactccagtattccataaagtttgagcaggatattgaatgtggtggtggatatattaaacttatgtctggttatgtcaaccagaagaaatttagtggagacactccatacagcttaatgtttgggccagatatatgcggaactcaaacgaagaagctccatcttatactttcttatcaagggcagaactaccctatcaagaaagatctgcaatgtgaaacagacaagttgacgcatgtttacacattcatactaaggcctgatgcgtcctatagcatactagttgataaccgtgaaagagaatcagggagcatgtacactgactgggacatcctccctcctcgcaagattaaggatgttcatgccaaaaagcctaaggattgggatgacagagaatatattgaggatccagatgcagttaaaccagagggctatgattctattccaaaggagattcctgatccaaaagacaaaaagcctgacacgtgggatgatgatgatgatggcatatggaagcctagaatgataccaaatccagcatacaagggaccatggaagcgcaagaaaatcaagaatcctaactacaagggtaaatggaagatcccatggattgataatccagagtttgaggatgatccagacctatatgtgctgaaacccttgaaatatattggaattgaggtttggcaggtaaaggctggttcggtttttgacaacatcctcatttgtgacgatccggaatatgcaagaaaagctgctgaggaaacatggggtgcaaacagggaggtaacatcacataaatatttacagaattgttgtctgctattcatatctgctaggcacaatcttagttttgtctacattgcaggccgaaaaagaggcttttgaagaagctgagaaggagaggaaagctagagaggataaggaagctgaacgagcaagggaggaaggagagcgacggaggagagagaggggtgatcggcaccgtggcagggattacaaggacagatacaaaagacgtcatagggatcactgggatgatgactaccatgatgagctttgaaatcacggaaaaatgctttcttcctaggagaagctggaatttgcatggtcattgcttataattgttaccaataaatgatctgggaggccagaatagccgcaagtgttccttgctgcgtgtgctgaaaatttgaatatccggattggaatgaaatgaacaaaagcctgaagatcattccttttggacagcagggcatacgattctacttaccagcaacacgttgtttttagttgtgaattggtgaaatgttgacgttgtaacgttgcgacttgcgaatataatgtgcacggggtgatgttctgcc

SEQ ID NO: 739 - DNA, 474 bp, Oryza sativa
cgtatttctcctttccccgaccccaagcaaagcacatcgactcctatcggcggtcgcgcgagctccagcgccaaggatccccgatggcggatacggcgaaggccgatgcggcggcggaggcggccaagatggacctgctcgaggacgacgacgagttcgaggagtttgagatcgaccaagaatgggatgacaaggaagaaggcaacgaggcagttcagcaatgggaggatgactgggatgacgatgatgtcaatgacgacttctctctgcagctcaggaaagagctggagagcatcccatcgaagaactagaacttgtggtcttgtattcagtactttcagataggaagtggtatctgctggatttggcatgtttactgttatatttaccaactcgagcattttgcttgttctgtggtatgcctttccgttatacattttattaccaaatacggttcataaaactatattgcct

SEQ ID NO: 740 - DNA, 1942 bp, Oryza sativa; identical to SEQ ID NO: 85

SEQ ID NO: 741 - DNA, 1897 bp, Oryza sativa
cattgcatcggaatgcttgcagctttaccgagccaccggagtagcctcgtcttctccggcgagccaccggcgatgggaagtcgcagcggcggccgccaccgactcttcctccgattcatcgccctctggtcgctgctcctcatcgccgccggggaggtcatcttcgaggagcgcttcgaagatggttgggagtcccgctgggtgaagtctgattggaaaaggagcgaagggaaagctggaacgttcaaacacacggcaggaagatattctggagatcctgatgacaaaggtatacagacaacgttggacgccaggcattttgctatatcggccaagatccccgaattcagtaacaagggccgtacattggtactccagtattccataaagtttgagcaggatattgaatgtggtggtggatatattaaacttatgtctggttatgtcaaccagaagaaatttagtggagacactccatacagcttaatgtttgggccagatatatgcggaactcaaacgaagaagctccatcttatactttcttatcaagggcagaactaccctatcaagaaagatctgcaatgtgaaacagacaagttgacgcatgtttacacattcatactaaggcctgatgcgtcctatagcatactagttgataaccgtgaaagagaatcagggagcatgtacactgactgggacatcctccctcctcgcaagattaaggatgttcatgccaaaaagcctaaggattgggatgacagagaatatattgaggatccagatgcagttaaaccagagggctatgattctattccaaaggagattcctgatccaaaagacaaaaagcctgacacgtgggatgatgatgatgatggcatatggaagcctagaatgataccaaatccagcatacaagggaccatggaagcgcaaggtttgttttttttgtctttggcaaccaatccttcttggtgcactatcttttaagagttcatattcatacattcttttgtgtacagaaaatcaagaatcctaactacaagggtaaatggaagatcccatggattgataatccagagtttgaggatgatccagacctatatgtgctgaaacccttgaaatatattggaattgaggtttggcaggtaaaggctggttcggtttttgacaacatcctcatttgtgacgatccggaatatgcaagaaaagctgctgaggaaacatggggtgcaaacagggaggccgaaaaagaggcttttgaagaagctgagaaggagaggaaagctagagaggataaggaagctgaacgagcaagggaggaaggagagcgacggaggagagagaggggtgatcggcaccgtggcagggattacaaggacagatacaaaagacgtcatagggatcactgggatgatgactaccatgatgagctttgaaatcacggaaaaatgctttcttcctaggagaagctggaatttgcatggtcattgcttataattgttaccaataaatgatctgggaggccagaatagccgcaagtgttccttgctgcgtgtgctgaaaatttgaatatccggattggaatgaaatgaacaaaagcctgaagatcattccttttggacagcagggcatacgattctacttaccagcaacacgttgtttttagttgtgaattggtgaaatgttgacgttgtaacgttgcgacttgcgaatataatgtgcacggggtgatgttctgccactttttgaacactgaacattttactgcatatcaagctagcaactgcaagcagcttcctgccaaagagtttgtcttcactgtattcatctgtgttattctaagaataatgccacagtgcaatcaacatacacgaatgcataagtttcagggtttcagc

SEQ ID NO: 742 - DNA, 7688 bp, Oryza sativa
acatgtcagttagaacccaagaggagagctcgtcgatcgattcccccgcgaaacagaaatctcgctctcgccgccgccgccgccccgcgtctcctcctcctcctccctggccggcggcgtgaatttgaactactccgtccggccagcctccgccgctccatgccatattcatcccctcctccttaaatcctagcaccctgacacctccagtcgccttccctagccctatcaacccttgtgtttgtgaatggttggatggattccatctcggtgaatgatctcgcgggatttttttttgggcacaattgcgatccgatccgggtatcccaccgatcgaccgaagccgggagggcacgggcgatcaactggtccgaaacaatgtgcttgctgatgtcacaatgtatataggattggcaacatgatcagaggctatgagcatggttatgtgctgaaaataacctctgttggtgatgtcgcagatatcagtattctggaaaatggcataaaatgtgggcatccagttctgttaattgctggtaatattgatcaggacactgtttcaatccagtccttgtggccaataagattggaagtgtatcggagtatggagactgcaagaaaacctggatgatatcactttccaattggaggctgaaagtgagctcaaaggagaagaaattttgggtggaagatgctttgaatgcaatggaagtgttatggttggtacccactatagtccatatcagaaggatgcagtggagaaagctattgctgttgctggtgtctatactcttttgaggctggcatctaaagttgacttcatcatagaatctcgagaatgattagcagaaggttgaggttgaaattgtaaggaaggccttcagtataatccctgaaaagagagttacttttgcaaaaggaacataataggcggtgagttgaggtgtcgcttggagcattctgcattggtggcaaattaagacattcctggcttgagagttgagacgtggttgtcgacgccatagagagcgagaacgtacacctggtcttctgcaacctgcaaaccaatggcagctagctctggtaatctctgcacctgatcccatgcacgcctttgactgtgctatcttgcaaatctagcatagggataccacgttgcagaatatggattctgattgagcaacggcacttggcttttctgtgaaactgtggcaactaaatcttttgcttacatacagataggacggctgcacttagcaacactacacccgtagctaagtgaagtgatttcatgaatgggtgtagcgttttctttaaccttcagtaaaagaatacttgatgccaaataggagtagttttcaacttaacatagggatagaaagtaaagtaaaatgggggtgaggggttcattggatactcaagagaagtctgtgattatgtaaggcccggaattttaaacaggtgcgtgcgcatttggcttgtcacacacacataggatgcccccctctgcttggctgcgtgttcgcttgtttctgcgtgcgcctgcacagctgcaaattttcaccagtgccagcagttgggaggtagcagtagcagtggtaaactagcaaaggcaaattcacagtggggggcctggctatccatccatctccttgaccttttttacctggagcatggaaggaaattccaaaaaccctcttgagctctttcgtgcttagacaaaaagaaaataccgtttgctccaagtccaaaccattgtacttttactgtaaggcaacccaagcacacatatagatactgctacattatgtctgcgtatgcatatagtgaccgttgttttgggtctttgtggttggtaaccactccttgcactgacagtatgactctacttattagacctgtgctgccgtgcattagatgtagtagtagtataacgttactgctagtagtattttgtttgtgaaggttagtaaaataattgatggattgtaaacaaagtctaccactatagtagcagtagtaatacaagaatagtaaaaaaacacaagatccgggtcggccggcctaggggtggaaggtggccgtccacgctccgtgcaaatgtgatcttcttcttcatcctagagaagaggagaggccaacggccggccattaatattccctcttcgatgcctgcataaaaagctgtgtactgtactactacccctctctctctctctctctctctgcctcactggcacctgtagtttagcgccgttgcacgctgcctctgtgtgtgtgacctggctggctggggctgtatgactttgcctatttggtgcctcgctgtactcttgggcccggggtctacttgcgaaaaaattttttaaccaaacaagatggaggaaaaagggcaaggattgaggaatatctctgtggtggagatgggtgattatacttgaatttgctggtgtttttttttctcattacttttgcacctccaatctttgcaactttcctaccttttggggaagaattaaatgtctgttcaagtctacaggggaatttaggccctgtttagttcacaccaaactttccccaaacttccaactttccattacatcacatccaaaactttcctactcacataaactcccaacttttttttccaaactaccaactttccccaaacttctctccaatttcagaaactaaacacacagttagtttttttttctatgcacagagttgaatagaaatttcagttaccccaagatatactattttaccagccatgatttttgaatcagtagtgcattagacatatcccaccaacaaatgaatgtagttgtagattatcccccaactaataatgtgcgtgtgcaatgattctgtcatttgcaaattgcaattgccgcctcaaaacgcaaatgccaatatgtgacacctgtgaagtgaaaatggtgttggcatcataaaatatttaaccaaccccaaagcatgggtaccttctaagttagccacacaactaatttaacagtgtactgctatcacacagctgtacaactggcatatcattgctatacaccagtacaaagtgctcgtgcccaccgttttatgctgtaatctctctcaacaactgaatagaaaatcaaccacaaaactccagctggtcaattcttagggatattcttgatgcggcgaaaatctctgaaagccaatctttggtgccacctgggtattgtgcactttgtactttgagctggaacgaacggcttgtgtcagttttggccgttggtaagggacaaacaatactggagaagagtattcatttccctcctgcaatatcttctcacagtgtagtagtatggtctaatgcgatccatacggaattgtacacaggagtacatccacatacatagaattgggtggtggccccaaaagtactctccatctacttgtagtagcctagtataatactggaatgtgatgttttactaactttgtaagcaaatcatgcatgtagccatgtaacttaggctcctttggcacatggtaattttcagaaagttgttacattcatccattcatgtaaaatccatgcatttctagtatcttcaaaaggaatatataggagtatatttcacaccattgatgtgtttatcttgtgtcttacaatactcctacctaaactagttcagttggttccagcgggggatgttaatacatgccgcatgagctatcagtcatgattgcagccaacatgtaattgtaatgcttctccaactgaaattgtcgagttgggaggtgaccctgacctgcacaaaaaggtgaaaaaaaagaaaaacaatcttgcagagaaagttctgcaatattatccatcgagcaaaccaaagcacaggtaggagaaaaactcccacatgtacattacctactcactaccggccagatatacatatatacagagtagtgtgtagcctggctaatcaattactaagagaaaaaaaaaacctccaatgttgctgctagcaatcttctacccatgctcatgcaaaggacagctactgagagcaagtttagtagtacaacccactacttactataagccaatattaaagctaacatgtataataggttagctataaggttagctttatttttttttcatcctctctctttatctctctatgaatttaatgcttatttcttggagcttgtgtggagctagctcttgcatgagagccatcactccccacttttctttatctcttccacataagcatttagcttgcttatagctcaccattatcctttctctcagagattgttgcaagggaggaggatatgcattgttttttatctttagttttttctttaagcaaatagggtagtgtagtactttgggtcatggggaacagcaaaaacagctgtctggggttgcatatgattagtagggcaaaagctagtgagtgtgtgtgtgtgtgagagggagagtgtgtgtgcaagagggaggaggggccttttgtgaaaataatgataagttttggggagcaaaaggtgagaggggagagggttttccaatccagcttccaagtcaaaagggtcgcccgggaacgaagaagaaagctcaaagctaagctgggctggctgctgcgggcatgccagcatcattgccgctcttttctgctctgttggcatccgagacgcctcctctgtaaaggcacaccaaagctctcttcttggaccctcaacaaaaattcagcaactgcaaatactattagttattatagttatgtcagttagtagtattagatacagggatcaattatcccttatttaattctccctaatgatccttttctgtgttttgtttactttctctctggatatatggtgtgccattcacaaagtgattgacttgctttatttcattgaggattctttccaaccttgtttaggctctggcttgtttgcccgttgattgagttggtccaagaatcaggatatatgatattcatgacttactggaaagctgttaagcaacagcactaacactggtactaagctaggcatgttcttttaccagatcagataattttcatctgtttactttctgttatgtgaaaatgatccgagatttattgctgtggagagcacacaagctggaaggaaaagatgagtatgggtgccatttttgggcttggagggtggtccttttctctgctgtacattttttttctacaggatccctgctgtacaatggtagtagcttcttgcttcaatcagggcaaatggaggacagattttagcttgagctaacatgtgagcaggctgctggccacagtgcatgtttgcacacatggtaggcccttaactgagtggactgaatgggggtaagggaagagagggaggtggtcgccgtcatggactgatgagggccgtgcgtgttcgttcgccaggccaggacaacccagcaagcatgctaactggctcacgcacacatagagcttgtgagagcttcttctttctctctctcttgtccttgtggtagctggtgcttaaaggaggaggaggtgaggaggaggcgcaatgtcggagcagccattgccgcagcctcggagcagcatgcgggaggcgctggagaaggaggacaaggagaaggcggcggcggccaaggagaaggccgccgtccccaagaacggcggcaacgggggaggaggcaagaacggcggcggtaacggcggcggcaacggtggcgccggcgcccagcccggggaggagacgacgagggagattcaggtggtgagggaggcgtaccggagggagccggcggcgccggcgtacgtgatgccggaggagccgccggccatggtggagctcgtcgggtggtacctctacggcttctgctcctacttcatcacccacctgctgctccccgtgctgttcccggccatcatcacccaggtcgccttccccgcctccgacttcaccccggacaccaagtacatcgtcaagggcgccacctgctccatccatgagatgtccatgtaccagaggctgaccaagcattcgattgccattgatggatcccggctgtccccgttgggctggagtggcctatcatgggcgattggaatcctcattgcggctccgatcctcacccaggctgcacaccaccttgaccgtggccagtatcagtcgctcatcctcattgccgcgacatcgtttggctcattcttctgcctcctcactggcttcttcaagacagtctgggtgttcctcttctacatcctgttcattggtgcatccatcattgttgctgaggctgtgcatacacgcaatcttggactcatgatccgtggccttgcagcacatgactctggcaagcaccttgtccttcgccgtcgtgctgctgccagtcagctcaccctgtattgcactgccattggtggcattggggctgcgctcatggctgctttcatgtaccacatgcttcggcgcactgaccagctcacaggcctttgggtcgtctccatcttcagtggccttatctggttcattggtatctgccatggtctcttcacaaaccgacccagcagctcatcgcccaccacagcatttgagcctaacttcttcaccaagctcagctacagcatgacccttgtgcgatacccacaggccatcggaagcttggttgcagtgttcctttcatctttcgccacaatgtgcatcttcaccagtggcacattgtatgctattggtggtgtttgcatcaagccagtccttgtgctcgtgctctggatactctacttcctgttcccgttgatctcacttccgctgctgcacccaatccagatcatcatccgtgctgatgctgttcgcatgcagctgcttgggttcatcatctgcctatttgtgtctggtgctggtttctacttcaagagccacaggtggagagccgctcacatcattgtgatcgctcttgtccagagcacagccaatggtgtgctgtactcatttggtcgcattctgctgctcgatgcctcgccaccagggaaggagggtgcttttgcggtgtggtatgcatttgtacgctgcattggtgctatgattggcttcgctgctgcatccgctgggcctgggcgtgctggaggatcgtttgctgctgcgttcctaggcagcttcctcggcatcattgttctgatctttggtaatgtgagcaacatcggggcgctgaaggctgctgggcatctgaagggaatggaagacgagaagaggctgggcatggagaaaggggaaggcatgagtgcggttgccgattccggcgagggaagggggagggtatgatgatgattaaatgggcttgtgggaaggaaagattggaaaattgctgtggaggttgtgtttgtgagagggatttgttcttctttcttgtttctttcttgttcatgtttcagtgacactgttaattcggtgctttgccccccttggatgcatgatgatgatgacatagtggtagaggaagtgtgctagttgttaatgtgttattctttgcttggaagacaattgtaactgatgatatggttctttgttcatcgccaccgaaattctctctggcagtcatgcttcgtggttgcttttctgttgaaaatgtgattgtcaaagtgaaataaaacccttatataatatttctattgcattgtgcaaac

SEQ ID NO: 743 - DNA, 3513 bp, Oryza sativa
gtagaagagagaagcctcaagaacaactcaccaagtcatctcatttccccatgcctcattattaattcctctctctctctctgtctcctatccctgtatactattttattctccattgtgtttttttttctctttctttttctttttattttcacaagcaaaattcttctcttttgggtgtttgtgagagagagagagagagagagattccatttccacaattccacccaactttgatgtacttgtagcagtagcagcagtagaagaagccaagaactgcttgtggagagcaaaaagatcgatttattgctgttttttggctcgagaaatcactggatattgcaactggggatctcaggaggaggaggaggaggaggattcggtcgagttcttgagctcgaatctgcctcgggaaccgcgcgaaggagcagccgccctttggagctccgagaggtcgcggccgcgtggtggtggtgatgccgcggcgagctcgatttggttgagattttgggcgccgatttcgtggccgtggcggcgtcgtcgtcggcgtcggagatggaggcgagcggcgaggagctcctgaagaagatccgggagctggaggtggggcaagcgcagctcaagcaggagatgtccaagctcggcggcgccgccgccgccgcggagcggaggcggtcgcagtcggtctcgccgcggcgcggcgcggcgccgccgccgccgcaccagccgccgctgccggcgaggcggctctccggggggttcgagggcggggcgcgcgcctgggcgcgcggctccgcgtcgttcccgcactcgtcgccgctgcagcgcgagggccgcgccgccgcggccgcgggcggcgggttgacggagaagcagtacaccagggtgttgcagtcgctggggcagtccgtacacattcttgacctcgaagggaagatcatgtactggaatcgatctgcagagaaactgtatggttatccagcatcagaagcacttggtcaggatggcctcatgctgctgattgattcctgtgatatcaatgtggtaaatgacatcttccgacgcatatctctgggtgagagttggaccggaaagtttccagttaagaacagagctggagatagattttcagctgttgccaccaacactcctttttatgatgaggatggcagtttggtgggcattgtttgcgtttcaagtgatttgcgcacaatggaggagataatcagtggcccttcaatctgtgcaaggccccatccagaatcttctaggacctactgtgaagctagttgcagcaacagcaatcgcaaagccagtttgttgagcagaagcccatttgactctcagcaacctttgcagtctactatagcctccaagataacaaatttggctacgaaggtcacaaataaagttcgttctagagtcagggcagatgaaaatggcattgagcgggaaggtggtagcggtgagagtcattgttctgatcgtgatgccaaggaggagccaacgtctagtggaacaactacgccaagaggggacgcaccacgcggagcctttgctacagaagagagttcccctgggaaaactgccaaaatgaacagtgatgaatcagaaggaaaagtagggttccacaggatcttgagttcaaaggcagaggcactgctgaacaagaaagggatatcatggccttggaaggggcgggataacgatggacctgatgtgaagaaccaagcaacctggccgtggttgcatggggagcaagatggcagccagaatcatcagaaaatttctgattctgccataactcaagatggtcaaggtgctgaatataaccaacctaacaaaaatgaggcatcaggttcctggtcctctttcaacaataacagcacaagcagtgcaagcagcacgggtagtactaatagtagtgctctttacaaagtagatcatgaagcagattgtttggattatgaaatcctgtgggaagaccttgtcattggagaacaaattggtcaaggctcgtgtggaacagtatatcatgctttgtggtatggctcggatgtggctgttaaagttttctctaagcaagaatattcagaagaagtgatacagaccttccgacaagaggtatcccttatgaagaaactacgccatcctaatatacttctcttcatgggtgcggttacatctccacaacgcctctgtatcgtaacagagttcctcccacgtggaagtttgtttcgcttacttcaaaggaacaataccaagttggattggagacgacgtgttcacatggctttagatattgcaagggggatgaactatcttcaccatttcagcccacttattattcatcgggatttaaaatcatccaatcttttggttgataagaactggactgtcaaggttgcagattttggtctttcacgtctcaagcgtgaaacattcctgacaacaaaaactggaaaaggaacaccacaatggatggctccagaggtgttgcgcaatgagccttctgacgagaagtctgatgtttatagttatggggtcatcctgtgggagcttgttactcagaagataccctgggaaaatcttaattcgatgcaggtcattggtgcagttggtttcatgaaccacaggttggagattcctagtgaaacagatcctcagtggacatcacttatcctgagttgttgggaaactgactcacaactccgtccatcgttccaacaacttctggagagacttcgagagctgcaaaggcagtacaatgtccagactcagatgcagcgaaatgcatccgctgctgcaaaaaatagcagcattgaggaatgaatggagatcccttatgaggcgaacgatcaattgacacaattttgcaggcggtgcagcgacacgctagcctgatcaggattcgcacctcccgcgtggttactgctgatgatgctgattgatacagccattgctgaagattgagcaagacgagggagctgcctcctgaatcctcttggcctgaagttccacctgcagcttcggaattctgaccaaggtagagagtactggagctgaggctggcacttttggtgaattcttccatgacaactccaatttatgcctagtcgaatgtcgaccaagctcgactctgtaacgcgaaggcgacaatgatcttgtgtagattgttctgacgatcgacaaccaaattgtattcgagttgctgatcctgattatgcatgaaagttgcaccatcaacattgtaaggttcaacctgttcttttgttctgctctgattccttctctgttactgtaaccatgttgtttagaatcccatcagaacccaatcattcttgctacttcgaccatggatggaagaaatatggaattgtgccttcaatttcacattattcaaactttggctgcaaataatttaaatgtcatctaagaaatacccagtagcattattagatttgacatctgtttttaagttttaacacgaatttattcataaagattgaagtt

SEQ ID NO: 744 - DNA, 3087 bp, Oryza sativa
atccctgtttgagatcatccctgcaccaaaaatccaactcataaagaaattcatattttgcaagtgaaattgtgggaacaaaaggaaaaaaagcccaaagccaaaagccaaagccaaaggcaagacagattgtgacagattccatatattgttttgattgtttgctcctatctctaaggaactctccaacctgaaaggattccaacttgaaaccaaagcttgctgcttcttttctctcatttgtctgaaattcatccattttttcagtagacaaggcaagaaaaggcaagttgtgcaaagttttgttcttcagattagcttggaggcaggcaaaagaaaaaaataaggcgccaaactttgtgtgctcctggatcataggaagaaatatccaagagattggtaaaaaaaggcgccatttttgagagaaaggcgtctccttgcgatcaagctggtgatgtgatcgaagagtagaggcggcgatggaggcggcggagctggtgaagaagatacgggagctggaggagggccaggccgagctcaagcgggagatatccaggatcgtgccggagcgcggcggcgcgcggcggccgccgacgctgcccgcgcagcagaggcgcaccgcgctcccgcaggcggcggcggcggcgccgtcgtcgcggctcctgcagcgcgtgggccgcgccggactccccgaccggcactacgtcaggatcctgcactcgctggggcaggccgtgcacgtcatctccctcgacggcaagctcatgtattggaaccggtacgcggagcatctgtacggctattctgttcctgaagcagttggtcaggatgcccttgaattaattgttcatcctagtgactatggtgcagcaaacgacatcatacagaatatattcatggggaagtgttggagagggaaatttccagttaaacacaagtcaggggagcgtttcaacatcgtcgccagtaacacgcctttgtatgatgatgatggtagcttggtaggcctcatctgtctctcaactgatacgcggacattggaggagatacttggccattcaacctcagggaaagtgtatccgagttcagcaaagccgcgcgttcaactcaatgggtccaaaagtggtttgctaaacaaagtttcttgtgactcccagcaacctcttcaatctgctatcacctccaggataacaaatttggctaccagggttacaaatagagttcgctctcgggtcaagacgggtcagaattgcgatgatcagttcggtggtgcctgtgagagccattattctgaacatgatgccagagaagagcagacatctagtgaaggaagcaccccaagtggggatgttcttcatggggcctttgttagtgaagacaattactctgggaagtcaagcaaaacaaacagtgatgactcaggagaaggaaaactggggcttcacaaaattcttagctcaacagcagaggcactgtgggccaacaggggaattccatggccttggagaggtcatggaaatgatgatgctgggaagaatcgaacgaacttgccacagttccatgaaattcaagagaatggacagagccataaggaagttccagagccaatcatactaccagactgccaagatactgaatttgtccaggaagtcaaatatgaggtttcaggttcctggtggtctttcaatgccagcacaagtagtatgagcagtactggaagcactaatagcagtgctatcgagagagcagatcgtgaagcagactgcctggattttgaaattctgtgggaagacctggcaattggagaacaagttggtcaaggttcttgtggaacagtgtatcatgctctgtggtatggttcggatgtggcagttaaagtattctccaaatatgaatactcagaagacatgatactcaccttcaggcaagaggtagcattgatgaagaaactacgccaccccaatgtgatactcttcatgggtgcagttgcgtctctccaacgactttgcattgttacggagtttctgccacgagggagtttgtttcgcttacttcaaaagaatgctggcaagctggatccaagacggcgagttcacatggctatagacattgcaagaggcatgaattatctccacaattccagcccacctattgtccatcgtgatttaaaatcatcaaaccttttggtcgataagaactggactgttaaggttgcggactttggtctttcacgtctcaaactcgaaacatttctgacaacaaaaactggaaaaggaacaccacaatggatggctccagaggtattacgtaatgaaccttcaaatgaaaactacggagttatcctatgggaaattgctactcagaagataccatgggataatctcaatacaatgcaggttgttggagcagtggggttcatggaccacaggttggacattccaagcgatgttgatcctcattgggcgtcgatgatcgagagttgctgggacaggtgcacatactatatatattttttcgacatttcaacatactacttctttgcaaattccgaagaaacaactgttctcaatgtaaaacaactgatcctagtattcaacaaacctatcctttctgcgagcagtgacccgcagcgtcgcccttcgttccaagaactgctagatcagctccgagatctgcagaagcaatacaacttgcaggctcaactgcagcgaactgcagctgccaagatgagtgttgacgattgctaacttcaaaatctgaatggtccatgttcagcttgttgccaatatgaggtcccagcaggccagcaaaatgggattcgttaggagtccagtctaaccaaaaagggttctgaattctgaacattttgctacttttctgaagaagctgtggcagcaattgagtttgtgccagaaaaagatggtgcattcgatctgaagcctgaagctctgcaactgcaattcaatcaatcttccagcagtgatgaccgatgaaatttcggcagtcatcgaatacaatgctgtattcaccctattaaccatgtacatgattttttttaaaaagaaaaggttgttgttggtattctgc

SEQ ID NO: 745 - DNA, 3375 bp, Oryza sativa
atagcagagacgccggccgagaggagtggggggagagggaggaggaggaggagagtggctactagtactagctatctttggagtgggcgtttcttggccggcggcgatggagcaggtgcggcggaagagtagcctgaggtcgcatggctcaggcaagtcctcgccgcgggtgggatcgggggtgttcgatgagcggtccggactggcggccgatcgtgacggcggcgaggaaggggaggtggtcgtgaggatcgacggggaggggccttgccgcgagccgttcgcgttccccggccaggatggcggtggggcggggaatgtgagcccgaacaccgactccacggcgagcacgccgcggggggcgagcaggacgtggtccagctggaccaactcgccgcgatccccgcccaaggtgaggcgggacgggagcgttgagttttggaagaatgatggcggcggggacgggggcagcgatgggggtggaggcagaggcggtggcggtggcggtggcggtggccggcgcgcctgcgaggcgttcagcttcaagaaccgggcgccgccgcggccttcgtcgtcgcaggcgtcgtccccttcgctatcgccgcagccggcacacgctgcgggtgcggtagacggcggcgaggatccgcccacgcgtctcatcgggaacttccttcggaaacagaaggcgtccggcgccgagctgtcgctggacctcgacatggaggagctcgggaggccgtcgcaactgcatgcgcagccatccttctcaaactccctggaacgcgaggcgcgagtctccttccaaccgaaaaggcgtgtcgcctcgtcctctgactccgactccgacaccggaggtagccgtaggcgcggcggcgacgacggcgaggttgttcgctgcacgtccagttccactgcagcgggacacttgatgcgagccaaaacgcgatcccggctgatggacccgccgccgcagccccagccggcgtccgcggtccctcccgtcggcgacgaggagaggagatcctctgtcttgcggacgcctacgaagtccggccagttcatctcgggcctcatgaccggcaagtccgggcaaatcgccaagtcgggcccgttggaagaggaggaggaggacccattcatggacgaggacatccccgacgaattcaagcgcgggaagctggacgccatcactatccttcagtggctcagcttggtgctcatcatcgcggcattggcgtgcagtctcaccatcaaggccctgtccgggaagaaggtctgggggctgcacctctggaagtgggagctcctcgtgttcgtgctcatctgcggccgccttgtctccggctgggtcatccggatcgccgtgttctgcgtcgagcgcaacttcttgctgcgcaagcgcgtgctctacttcgtgtacggcgtgcgcagcgccgtgcagaacgcgctctggctcggcctggtactctcctcttggcacttcatgttcgacaagaacgtccagcgggagacgaactcgcctgtgctgccctacgtgcagaagatactgttctgcttcctcgtcgccacgctcatccgcctcgtcaagacgctgctgctcaaggtgctggcatcctccttccatgtcaacacatactttgaccggattcaggaggcattgttcaaccagtttgtcatcgagacgctctccgggccgcccctagttgacgaaaaccaattccttgctgagatgcatgagcttcaacgcgcaggagcaaccatcccagctgagctccgttccactgtaccaaccaagaatctttcagggcaaaggagtattcggatgtccggggtgattcctaagggagaagggagcaagcagctgtcaaaagagaaaggagagcaccagattgaggaggggatcaccattgacaagcttcataaactcaaccagaaaaatatctcagcttggaacatgaaaaggttgatgaggattgttcggtttgggacgctcacgacaatggatgagcagatacagcaggcaacgggtgagggggatgagtcagcgacacagattcgtagtgaatatgaagccaagattgctgccaagaagatctttcacaatgtggcgaagcctggctccaagtatatatacttgtcagatttgctgcgtttcatgaggcaggaagaagccatcaaaacaatggatcttttcgaaggagcacaggagcacagcagggttagcaagagatctctaaagaactgggtggtgaatgcatttagagagcgcaaagcccttgccctaacacttaatgatacaaagactgcagtgaacaagctcaaccagatggttaatgttgttgttgggataattgtgtttgccctctggctacttattctgggtatagcaacaacacatttctttgtcttcctcagttcacaagttcttgtggcagtttttgtatttgggaatactttgaagacaatttttgaggcaattgtgttcttgttcgtgatgcatccttatgatgttggtgatcgctgcgaaatagaagattgtcaggtggttgttgaggaaatgaatataatgacaacagtgtttctccgatatgataacctgaagatctattatccaaacagtgtacttgccacaaaaccgattatgaattactacaggagtcctgatatgggagaaggaattgacttctccgttcatgttgccaccccagtggagaaattagcccttatgaaggaaagattattacgttacatcgacaacaagaaggaccattggtatcctggtgcaatgattgtcctccgtgatgtggatgacaccaacaagctgaaagtgtccatatggctccggcacacactcaactggcaggacatggggatgaggttcgtaaggagggagctggtgctccaagagatgatcaaagttctcaaggacctcgacatagaatacaggatgctgccactcgacgtgaacgtgcgaaacgcgccccctatccagtccacgaggatgccaacgacatggaactattcctgattactgaatcggtgaatgcaccagatcattcagctatgagattacagagaggaggaaatgcctttgatcgagtttgagctgcaagatcctggtggcaactagcaagtgttctgcgctgcaagagcttggtaacaactagcaagtagtggatagcatgtaaaaactagcaatggttgttattgttagtgtgcttgaagccatcatcacttggtagttggtgcagtatgtaattactggtgctgtgtagttgatggataacgtagatacagagataaagagttttcattccaaatggtgaaagcagtaataaaaagttcaatgggtgaactcctatttctgattcc

SEQ ID NO: 746 - DNA, 1591 bp, Oryza sativa
ttttcctcccctttctatcctccacctcggcttatctcctcccccctccccaccaccaccaccaccaccatggccacagccgcttccctctccgccaccgcctcctccctcctcgcccccgcccccgccaccaccggcgccgcggcggcgcagtgctgctcctcctcgtccaccgcgctgttccccacccccgtcccgtcgctgcgcgcctactacccgcgcctgctcctcgcgttccgccgccccgccgtcgccgccgtcgcagacccgcagggcgccgtgctcgaggaggagcagggggagcagcaggacgaggggcaggagcagtacgacgacgacgactacgacgacgggtacgagggcggacgcggccccgcgttcacgccccccacccgcccgcgcaccggcaaggccgcccttccgctcaagcgcgaccgcacgaggtcgaagcgattcctggagatacagaagctgagggagagcaagaaggagcacgacgtgcccacggccatctcgctggtgaagcagatggccagcgcccgattcgtcgagtccgctgaggcgcacttccgcatgaacctcgaccccaagtacaacgaccagcagctccgcgccacggttaatttgcccaaggggacgggccagtcggtgaagattgcggtcctcacacaaggtgagaagatagatcaagcaagagctgcaggagctgatattgtcggtggagatgacctgattgaccaaataaaaggaggatttatggaatttgacaagctgattgcatcacctgatatgatgcctaaggtcgccggattgggaaagattctaggaccgagaggacttatgcctaaccccaaagctgggactgtttctccaaacataactcaggctatcgaagagttcaagaaaggtaaagttgaatacagagttgacaagacagggattgttcacattccctttgggaaggttgattttcctgaagaagaccttattgcaaacttcatggctgttgttcgctctgtcgaaaggaacaaaccatctggtgcaaaggggatatactggaaaacggcatacttatgctcatcaatggggccttcaatcaagttaaacatcaaagaaatgcttgactatggctcagaatcatcagactaaatgccacgaaaagcaccagttaagaaatctggtgtttgctaccaccttcacaaaattaaccatccacccttagcgataaatgaaccgggaaacatggtgggggaaggcaagggaggtgcttaggtacagtttttttttcagtctcacctgcatccatccagcagttacacgatgcccaagtcgacgaaggggtgatattgttggccatttgtacttacgagcaaattatttacggacttatagatgtgttttctgagatgtttgttgtaatgatcaatattttgtccatagtcatccttgagcttacgacagcagtttattctcaccagtacttgcggttcctgaatcgttgcaagtttgcattgtgccatttttgaatgatagcagcagcggttcgatttatgcgagaatagtaatacaagtactatctgaagctcttatg

SEQ ID NO: 747 - DNA, 2198 bp, Oryza sativa
cttccactccactccaccagaccggccaccacttgcccactccctcgctactactagtactagtcctacactatacgctcccggatggcggacgccgctggcatcgccaccgtcctcgccgccgacggcagggacttcctcctccgcaactccgccgaccagacagacggtcaaatgttggacacggatttccacggctgcacttattttgggacggaggtgaagatcagcagcatcgaggcaagcaccgttgccctctacttctcggcctcatggtgcccaccatgcaggcgcttcacgcctaagcttattgaagcatacaatgagctggtctcccagggaaagaacttcgaggttgtctttgtttcaggggataaggatcaagaggcattcgatgcatactttgcaaagatgccatggttggcagtccctttctcggactccgaatgccgtgccaaactcaataagcgctttaaggtgagaggcattccacacctcgtcatccttaatgcaacatctggtgaagtttatacggaagatggagttgagcttgtgactgtgcatggtacagaagcttacccttttacaacagagaggatcaatgaattgaaggaacaggaaaaggcagctaaggataatcaaactgttcaaagtgtgcttggtacacccacccgcgactacttactttcgaacaagggagatagggtacccatctctgaccttgagggcaagtacgttggtttgtgctttgtggtgaatggctatggcccagtagtccaatttacctcattgcttgctaaattttatgagaaactcaaagaagtaggggagaaatttgaagttgtagctgtatccttggacagtgatgaggaattatccaatgagagttttgcaggcatgccttggcttgccatccctcaggaagacaagatgggtgagaagctggctcgttattttgagcttagaggcctgcctacacttgtcctgattggtcctgatgggaagacactgaacaacaatgttgctgacataattgatgagcatggtcaagatgcatgggaagggtttcctttcactgcagagaagatggaaattcttgctgagaaggcaaaggctaaagcagagttacagaccttggagtcccttctggtcattggtgatttggactttgtgcttggaaaagatggagcaaaggttcctgtatcagaacttgttgggaagactgtcctcctctacttctcagctaaatggtgcggaccatgccgagccttcctgcctaaacttgtcgacgagtacaacaagatcaaggagaagcacaacgacttcgagatcatcttcatctccagcgatcgagaccagagctcctacgacgagttcttctccggcatgccatggctcgctcttcccctgggtgacgagaggaagcagcacctgagcaagaccttcagagtccgcgggatcccttcgctcgtcgccatcggcgccgacgggaggacggtggccagggacgccaagaccccgctgacggcccacggcgccgacgcgttcccgttcacggaggagaggctcctggagatggagaggaagatcgacgagatggcgaaggggtggcccgggaagctgaagcacgagctgcacgatgagcatgagctcgtgctgactcgctgcaccacgtatggctgtgatggatgcgacgagatgggcagctcgtggtcgtacaggtgcagggagtgtgacttcgacctgcaccccaagtgcgcgctggggaaggaggaggagaagaagggcgatgacgaggctgaggctgaggctgacccagcatgcgagggaggcgtttgcaggaaggcctaaaagagacttgttcttccactggttatctactgctgatttaagcgtgcctggatgtttggatgtgaaattagagaattatgtagtgagtaataaatatggttttgtttacaaagtagtggtattggggttgctggtacattggtatttgtgttgatgaacattagttgagaccagagctttggattattcattattatgtgcaaaccaaaaccatatgtaagtatgagtccggattggtaattgggtatcttgaatcatgttgtgagtaatagatcttagagcagtcagaaatctatctatattaacttattaaagaaatagaaaaaggagcctccacgttcgctctc

SEQ ID NO: 748 - DNA, 1654 bp, Oryza sativa
cattgcatcggaatgcttgcagctttaccgagccaccggagtagcctcgtcttctccggcgagccaccggcgatgggaagtcgcagcggcggccgccaccgactcttcctccgattcatcgccctctggtcgctgctcctcatcgccgccggggaggtcatcttcgaggagcgcttcgaagatggttgggagtcccgctgggtgaagtctgattggaaaaggagcgaagggaaagctggaacgttcaaacacacggcaggaagatattctggagatcctgatgacaaaggtatacagacaacgttggacgccaggcattttgctatatcggccaagatccccgaattcagtaacaagggccgtacattggtactccagtattccataaagtttgagcaggatattgaatgtggtggtggatatattaaacttatgtctggttatgtcaaccagaagaaatttagtggagacactccatacagcttaatgtttgggccagatatatgcggaactcaaacgaagaagctccatcttatactttcttatcaagggcagaactaccctatcaagaaagatctgcaatgtgaaacagacaagttgacgcatgtttacacattcatactaaggcctgatgcgtcctatagcatactagttgataaccgtgaaagagaatcagggagcatgtacactgactgggacatcctccctcctcgcaagattaaggatgttcatgccaaaaagcctaaggattgggatgacagagaatatattgaggatccagatgcagttaaaccagagggctatgattctattccaaaggagattcctgatccaaaagacaaaaagcctgacacgtgggatgatgatgatgatggcatatggaagcctagaatgataccaaatccagcatacaagggaccatggaagcgcaagaaaatcaagaatcctaactacaagggtaaatggaagatcccatggattgataatccagagtttgaggatgatccagacctatatgtgctgaaacccttgaaatatattggaattgaggtttggcaggtaaaggctggttcggtttttgacaacatcctcatttgtgacgatccggaatatgcaagaaaagctgctgaggaaacatggggtgcaaacagggaggccgaaaaagaggcttttgaagaagctgagaaggagaggaaagctagagaggataaggaagctgaacgagcaagggaggaaggagagcgacggaggagagagaggggtgatcggcaccgtggcagggattacaaggacagatacaaaagacgtcatagggatcactgggatgatgactaccatgatgagctttgaaatcacggaaaaatgctttcttcctaggagaagctggaatttgcatggtcattgcttataattgttaccaataaatgatctgggaggccagaatagccgcaagtgttccttgctgcgtgtgctgaaaatttgaatatccggattggaatgaaatgaacaaaagcctgaagatcattccttttggacagcagggcatacgattctacttaccagcaacacgttgtttttagttgtgaattggtgaaatgttgacgttgtaacgttgcgacttgcgaatataatgtgcacggggtgatgttctgcc

SEQ ID NO: 749 - DNA, 2324 bp, Oryza sativa
gggcggggaagaggagcgtctacctgatggactgcgcgccggtgtggggctgcgcgtcgacgcgcggccgcagcgcggagatggaggacgcgagcgccgccgtgccgcggttcgcggacgtgccggtgcggctgctcgccagccggcgcgacctcgacgcgctgggcctcgacgccgacgcgctccgcctgccggcgcacctcttcggcgtgttcgacggccacggcggcgccgaggtggcgaactactgccgtgaaaggatccacgtcgtcttgagcgaggagctgaagcgacttggcaagaatttgggggagatgggcgaggtggacatgaaagagcactgggatgatgtgttcacgaaatgtttccagagagtggacgatgaggtttcagggagagtgaccagggttgtcaatggtggcggtgaggtccggtcagaaccggtgaccgcagagaacgtcggctcgacggcggtcgttgcgcttgtctgctcatctcatgtggtggttgccaactgtggagattcgcgcatcgtgctctgccgcgggaaggagcccgtagccttgtcaattgatcacaagcctgacaggaaggatgagcgggcaaggattgaagcccagggaggcaaggtcatccaatggaatggttaccgggtgtccggtatacttgctatgtcccgatcaatcggtatgcatattgatccctgtgctagatctaggctgaagcacttgtctgtctcttttccctgtaaatgagttgtgtgacactgccatagtaaggactgtgctttgggcctggaaattgtggccatggcaagaacaaagcacatgaaactatgcgacatgatgtaaaaaattacatgatcttacattgattttggcctattgccaccttgttttgagatcttctgcatcatagtgctgtagaattaattgttgccatatattatatgatgatgttaacactatgttagtgcaagtccccaagtcctttgccattgcttgtagttttcggcactaagaaaagtatatcaatagtggattatttcagattggctaggcaaaatgtcctgttaccgtattgcccaaagaactattacgctagatcttatttttagtgatgaatatattacgtgctgtgagatatttccatggtgttgtattattcattaggaatatatttacctacaagtaacagcagtttgggccctaaaatcttgtttctatgcgagacatacatatgtgaagattctgcaatcatgtgactatctggatattgccagtttggcactaatcttgttgatgaacttgcgatgaggttaaacatatctctgttatagaattgagtatgcagatttgattaggaaaagaagttacctgccaaagtagaaaagccatcgtttatcgaagcaacaaaggtaccttatgtcatgttcatgcaagtggcacttgcagcttggaccatgactaaatgggtcttagttggacctgttcacatctcttgcgccattcaaataaactaactctattgtgttatacacttggacaacattgttgctccatttcacctgaaatttggttgaaccaatgacagttcagctgacttccctgtgcattggattgcatttgtccaaatttagtgccccttgtgctaattttatccgtgttcctgatgttgcaggtgatcgctatctgaaaccatttgtcattccaaaaccggaagttatggtcgttccacgggcgaaggatgatgactgtcttattctagcaagcgatgggctgtgggatgttgtgtcaaatgaagaggcatgcaaagtcgcacgccgacagatccttctgtggcacaagaacaatggcgctgcatcaccattgtctgatgagggtgaaggatccaccgaccctgctgcccaagcagctgccgattatctgatgagactcgctctgaagaaaggcagcgaggataacatcactgtcattgttgtcgacttgaaaccgcgaaagaaactcaagaacatttcataacagggcctgggttcatcttgagtagctgaccatgatgtgtgtcaaagagtttcatacaactagtcggtcttcctcacgggacttgacccactgttttttttgctgggcttcaagaaattgtacatgtatatgctagatgtatcttccatctagggataaatatctacctacctccattctatcccgtcagcttcagttttcagccctggcaagaagtatcccttgtacaataattgaacttggaaaaagctaagtggctgagatgaccagtaaaattaacataattgtgatcacctttcctga

SEQ ID NO: 750 - DNA, 2958 bp, Oryza sativa
atccctgtttgagatcatccctgcaccaaaaatccaactcataaagaaattcatattttgcaagtgaaattgtgggaacaaaaggaaaaaaagcccaaagccaaaagccaaagccaaaggcaagacagattgtgacagattccatatattgttttgattgtttgctcctatctctaaggaactctccaacctgaaaggattccaacttgaaaccaaagcttgctgcttcttttctctcatttgtctgaaattcatccattttttcagtagacaaggcaagaaaaggcaagttgtgcaaagttttgttcttcagattagcttggaggcaggcaaaagaaaaaaataaggcgccaaactttgtgtgctcctggatcataggaagaaatatccaagagattggtaaaaaaaggcgccatttttgagagaaaggcgtctccttgcgatcaagctggtgatgtgatcgaagagtagaggcggcgatggaggcggcggagctggtgaagaagatacgggagctggaggagggccaggccgagctcaagcgggagatatccaggatcgtgccggagcgcggcggcgcgcggcggccgccgacgctgcccgcgcagcagaggcgcaccgcgctcccgcaggcggcggcggcggcgccgtcgtcgcggctcctgcagcgcgtgggccgcgccggactccccgaccggcactacgtcaggatcctgcactcgctggggcaggccgtgcacgtcatctccctcgacggcaagctcatgtattggaaccggtacgcggagcatctgtacggctattctgttcctgaagcagttggtcaggatgcccttgaattaattgttcatcctagtgactatggtgcagcaaacgacatcatacagaatatattcatggggaagtgttggagagggaaatttccagttaaacacaagtcaggggagcgtttcaacatcgtcgccagtaacacgcctttgtatgatgatgatggtagcttggtaggcctcatctgtctctcaactgatacgcggacattggaggagatacttggccattcaacctcagggaaagtgtatccgagttcagcaaagccgcgcgttcaactcaatgggtccaaaagtggtttgctaaacaaagtttcttgtgactcccagcaacctcttcaatctgctatcacctccaggataacaaatttggctaccagggttacaaatagagttcgctctcgggtcaagacgggtcagaattgcgatgatcagttcggtggtgcctgtgagagccattattctgaacatgatgccagagaagagcagacatctagtgaaggaagcaccccaagtggggatgttcttcatggggcctttgttagtgaagacaattactctgggaagtcaagcaaaacaaacagtgatgactcaggagaaggaaaactggggcttcacaaaattcttagctcaacagcagaggcactgtgggccaacaggggaattccatggccttggagaggtcatggaaatgatgatgctgggaagaatcgaacgaacttgccacagttccatgaaattcaagagaatggacagagccataaggaagttccagagccaatcatactaccagactgccaagatactgaatttgtccaggaagtcaaatatgaggtttcaggttcctggtggtctttcaatgccagcacaagtagtatgagcagtactggaagcactaatagcagtgctatcgagagagcagatcgtgaagcagactgcctggattttgaaattctgtgggaagacctggcaattggagaacaagttggtcaaggttcttgtggaacagtgtatcatgctctgtggtatggttcggatgtggcagttaaagtattctccaaatatgaatactcagaagacatgatactcaccttcaggcaagaggtagcattgatgaagaaactacgccaccccaatgtgatactcttcatgggtgcagttgcgtctctccaacgactttgcattgttacggagtttctgccacgagggagtttgtttcgcttacttcaaaagaatgctggcaagctggatccaagacggcgagttcacatggctatagacattgcaagaggcatgaattatctccacaattccagcccacctattgtccatcgtgatttaaaatcatcaaaccttttggtcgataagaactggactgttaaggttgcggactttggtctttcacgtctcaaactcgaaacatttctgacaacaaaaactggaaaaggaacaccacaatggatggctccagaggtattacgtaatgaaccttcaaatgaaaactacggagttatcctatgggaaattgctactcagaagataccatgggataatctcaatacaatgcaggttgttggagcagtggggttcatggaccacaggttggacattccaagcgatgttgatcctcattgggcgtcgatgatcgagagttgctgggacagtgacccgcagcgtcgcccttcgttccaagaactgctagatcagctccgagatctgcagaagcaatacaacttgcaggctcaactgcagcgaactgcagctgccaagatgagtgttgacgattgctaacttcaaaatctgaatggtccatgttcagcttgttgccaatatgaggtcccagcaggccagcaaaatgggattcgttaggagtccagtctaaccaaaaagggttctgaattctgaacattttgctacttttctgaagaagctgtggcagcaattgagtttgtgccagaaaaagatggtgcattcgatctgaagcctgaagctctgcaactgcaattcaatcaatcttccagcagtgatgaccgatgaaatttcggcagtcatcgaatacaatgctgtattcaccctattaaccatgtacatgattttttttaaaaagaaaaggttgttgttggtattctgc

SEQ ID NO: 751 - DNA, 2930 bp, Oryza sativa
aaaaatctctttcctctatcctgactccctgagtaaatctctttcctctgttgtgggattcccctttcctacgaactctcctgtcgttctacggttctcctcctcgtcttcatcggtgttgatctgtaggtaagatgccgggcgctttactgacccaccgccccaagcaggcgctcctagatcttccaccgctccgctccgtcggctgctgtaccagccatcactgctgccgcaccttcctgccgattaacagccacgagcaggcgacccccatgccccatggatgatgtagggcatgcggcgggccggagacgcccccagccgatgtgccgggtgaccggggcactgcaattgatgcgggttatacctcccgacaccggctgtccacttcgctctgctccacgctgcgcggctggcggcaatgtttccaagccccggaatctctgcctccctctgcacatcttactacctctctgagtcgccaaattgcaatggaggctaattcccttccaggactacaatacttaccaatttgatatgttgtattttcaggtttggagtcagatgcactgaccgtccatagctgaaggagcctggtctacgtacagctaggcttcacacaactatatggcaaggagtagaaaaaggcgtattgttcagagcaatgaggaatatttgtcagaggaacagactgaagaagaaaatacccttccacagcttgccacaccatctgaacaaaaaactgtatgtgatgattctggagaaggcaatgaagacactgatgacgattttaatatcaatgatggagaaggcaatgaagacactaatgacgatgttgatattgatgatgaaggcaatgaagatactgatgttgatattaatgttcgagttgaaaatggagcacctgaaacacgtggcaagacaaaactgaaagatgtttggaaccttccgaaagggcttagaattgtggtacaatgcaatgatctcaatcaggcggtaggggaagaagatggaattttgggtaaatttcttggaatgatatctaggaatggtagtctgtgtagcttaggctacacagactggagatatgtaataggaaagagagagaaaaatacaaatgaactaaaagttaaaaaggacatacttaagcaagtaaagatgagattcctttatgctcctcggatggaagagttcatattaaaaaaaattggagaaagatggcggcaatataaagcaaaactaaaagatttgtattttgatgtgaatgagactaaggaagctaattgcaacaatgtcccagaaggtgtgctttctgaccagtggattgctcttgtcaatcattggatgaacgagaaatcgaagagaataagtgagcagaataagaaaaactgccaaaagaagaaggcaattcacacagcagggacaaagagttttgctcgcacaagagaagagatgagacaaaaagatcctgcaaagaagaacccacatagagctgttgtttatgtccacacacacaagcgcaaaagtgacaagaatataaatgggcatgtggataatttgaagagacttatagctgaacaaccagctttagcggatgctagtaaaggaaagactgcttggaaaggagatgcattgaaccaaatactaggagatgacaagcctgggcgtgtgcatggtcttggactagttccaaagcctaaacaagtgcttgatgtgccaacttcccgacgtttgcagaatataaatcttactacagtggaggataactccagtgaagatgtaatggctattagactgcagatggaaaagttagaacgccatgttgagaataatgatgctgaacttttacaattaaaagagaaggcaaccaagttggaaaaggcacaaaagaatcagggaggtttagatggagcatctacaaataaaaaagctatttgtgatgacgtacctaattcaaaaaggaggagagtgtatggtgacaacccctcgcaagaaatttgtatgtttgaggagggaaacattatggatcagcaggacaacagtttgatgaatacacaaagccatgtgcacgatgagaatttgcaaccaccaaccaagcattctactgtttacaagcgcaaaggaaatttggaccataatgagcttatgcaaccagggaagagtatttctagtgcatacaagaacaataaacctgacaaccaggacaactatatggtgaatgcacacaaagttacaagtacacacaagaacaaagagaaccttacccgcaagcttgttagaccaagcctaaacaagtatagtactgcttctaagaaacggcaatgcaacacaatagactttttaactgacaattcaacagtgaaagtgtatggtgacggtcccttgcaagaaatttgtcatgttgaacaggaaaacattgtgatgaattcacaaagccatgctcaagatgaggataagacaccaccaaccaagcatgctactgcacacaagaacaaacgaacctttggcctaaatgaccatgggaaacagatggagattatttgtgccaagaacaagaaacctgacaatcaggacagccatatggtacatgcacataaagttggtggtgcatacaagaaacaacagtgcagcaaaatggactttatcactgacaattcaatggaggttgacaagataaatgggtgaagatgtgggggaaattttgtgactgctagtacgcaactaggtcacctgtacatgtcacggaatgatgatggctgcaaggtggagaatgggggcaacaagatgtgttttttttatatactttagattctattttctgcattaatgttctgaacaaaggtttaatgccatgaattatactgatgattgtctatgtaatgcaaaatactatatttaatatataatcgattatcatgattgattggact

SEQ ID NO: 752 - DNA, 1779 bp, Oryza sativa
atgagcgtcaagatggcggacgaaagcgagaggggcggtatggtaatcgacgacgtcggcggcggcggactgaatcttgcaattgttgcaggcaagcgtaagcgggagatcacatgggaagagaaggcggcgttgacagttcttgatattcctgccgagcgtgattgcagcctcatagactcggagaaagattactcatctatggctggctgccaggccggagaacacgctagtatatttggcattgacaagaatggggatgattctgatgaaccgtgtgctaaggatgatgccaatcaaagtgatatggctgctctgaaggaggaggaggagaattgggagctggacagtgaaccagagctcacatgggatgagaaggtggttcaagttctaaacatggttcgacaccgagagatcaccgaatataaccccaagcagttttgctcaattcctactcgattttgtgcctacaacatagccttctttgacctggacaaagagtcaaagcttgcacgtggaccacctatcaagtcgctagctttccctgactactggtgggagatggactctgtcaatgtgattgcaatcaaggtggccgagtctgatgtgggttaccctatcagggtatttggcactgtgctggccagggatgagtatgatttcaggtgtgtctatctgttcaggcgtgacaggaacaatccccagatcatcacctcgccggaggacacactaactctgacaggacctaatcgagcgctgggtgcaacagacaaaatgtatttcgagttcaatttgaagattagagacgatggcgatgtcgacaaagatttctgcaaaggtgtgcgagaacacaatgccatctgctatacaaagcagccgatgactttatcgctagagagctgcctgagtacaattgattttgtgtatagtcctgttcaattagctgtggaagcttctgttgcagtcaaaattaagggggttgtatccacgtttttcactggcaaagtgactgcttggactactggagatgatcagaacaaaatcatcctgtatgacagtgaagtggaaggcagcaacagagttgttggagctgatggatcagtcgatctgactcgctgtttcgtagccgtcaatttggatgatgaactggtgctcaatgtctgtgtttctgaaggagctggctcaatctttgagctcgttcttggacacaatgatgaagaatgtgtccgtgagcaaggtccctatgaactgcaggtgaatgttgtttggacagctgcctttaagcatcgacagcgcagaaaattgtttgagcgtatcggtgacttccgcgtgttaaggggtgaaaactatcggaaacggtcagaatcggtagcatctctttggaaacgatgctcgatcggccgggtgagcgcagagcgccaccagccaccagcgacgccaccaccccgctgccgcgcgccgtcaccaagcgccgacgccgtcccagccgccagggtggggccaggggcagaaatgtccatgaacagccgattcttgctctgttcccagaacgatctccatcttggattccgcttcgttgcctgcaatgtttttatctggacagatgctggtgctcagtccattgcttgccttgatgttggatcaattgaggaagctccctgcatttgtgcaagatggcctttttgcgagcagtcagcaccatcggtgcctttttggtgtgggctatcaagaccatcgacagcttcctcccttgtccccaccggccatccgctttgcaac

SEQ ID NO: 753 - DNA, 2253 bp, Oryza sativa
atgaggaatatttgtcagaggaacagactgaagaagaaaatacccttccacagcttgccacaccatctgaacaaaaaactgtatgtgatgattctggagaaggcaatgaagacactgatgacgattttgatatcaatgatggagaaggcaatgaagacactaatgacgatgttgatattgatgatgaaggcaatgaagatactgatgttgatattaatgttcgaggcaactgctaagtttaatagtcctaatgttgaaaatggagcacctgaaacacgtggcaagacaaaactgaaagatgtttggaaccttccgaaagggcttagaattgtggtacaatgcaatgatctcaatcaggcggtaggggaagaagctggagttttgggtaaatttcttggaatgatagctaggaatggtagtctgtgtagcttaggctacacagactggagatatgtaataggaaagagagagaaaaatacaaatgaactaaaagttaaaaaggacatacttaagcaagtaaagatgagattcctttatgctcctcggatggaagagttcatattaaaaaaaattggagaaagatggcggcaatataaagcaaaactaaaagatttgtattttgatgtgaatgagactaaggaagctaattgcaacaatgtcccagaaggtgtgctttctgaccagtggattgctcttgtcaatcattggatgaacgagaaatcgaagagaataagtgagcagaataagaaaaactgccaaaagaagaaggcaattcacacagcagggacaaagagttttgctcgcacaagagaagagatgagacaaaaagatcctgcaaagaagtacccacatagagctgttgtttatgtccacacacacaagcgcaaaagtgacaagaatataaatgggcatgtggataatttgaagagacttatagctgaacaaccagctttagcggatgctagtaaaggaaagactgcttggaaaggagatgcattgaaccaaatactaggagatgacaagcctgggcgtgtgcatggtcttggactagttccaaagcctaaacaagtgcttgatgtgccaacttcccgacgtttgcagaatataaatcttactacagtggaggataactccagtgaagatgtaatggctattagactgcagatggaaaagttagaacgccatgttgagaataatgatgctgaacttttacaattaaaagagaaggcaaccaagttggaaaaggcacaaaagaatcagggaggtttagatggagcatctacaaataaaaaagctatttgtgatgacgtacctaattcaaaaaggaggagagtgtatggtgacaacccctcgcaagaaatttgtatgtttgaggagggaaacattatggatcagcaggacaacagtttgatgaatacacaaagccatgtgcacgatgagaatttgcaaccaccaaccaagcattctactgtttacaagcgcaaaggaaatttggaccagaatgagcttatgcaaccagggaagagtatttctagtgcatacaagaacaataaacctgacaaccaggacaactatatggtgaatgcacacaaagttacaagtacacacaagaacaaagagaaccttacccgcaagcttgttagaccaagcctaaacaagtatagtactgcttctaagaaacggcaatgcaacacaatggactttttaactgacaattcaacagtgaaagtgtatggtgacggtcccttgcaagaaatttgtcatgttgaacaggaaaacattgtgatgaattcacaaagccatgctcaagatgaggataagacaccaccaaccaagcatgctactgcacacaagaacaaacgaacctttggcctaaatgaccatgggaaacagatggagattatttgtgccaaggaacaacagtgcagcaaaatggactttatcactgacaattcaatggaggttggaactaaagtattcttaaaaagttggaaaaatcggaatacaaacgtggctcttgccactattgtaagctgtgatccaacacgcagagttggaggtgttgagctaggaaatgaatttttaatggttcatgtcgatcttgcattggcaaaatccgaagatttgattaggccatacaaaggctacaaaattgttggtcatgttgtaggacttgaaattgcgtggcctgcaatttttatatgttcctatctcttacttcttacttcggagatgtgcttttcgtcttcataa

SEQ ID NO: 754 - DNA, 1497 bp, Oryza sativa
aaaaggaaaaatccgcttcactcgcctcctttctcctcctccgtcctcgtcctggtctcgcggactcgctccctcctcccctccgccatcgcctcgctcgcgcagcaatccgcgacaaatccaccagccaatcgcggcatcgcgcccatcccttcccctatactgcaaatccgcttccccgagatggaatcctgtccttcggtgaagaacattcttgtgctggattccgaagggaagcgcgtggcggtgaagtactacagcgatgactggccctctttgtcctcgaagcaagctttcgagaagtcggtctttgctaaaacccagaaaacgagcgctagaacagaagctgagatagtaatgtttgacagttacttcgttgtatacaagttcatccaagatctacacttttttgtaactggaggtgatgaagagaatgagctcattttagcatctgttcttcagggcttctctgaagctattgattaccttctcagaaacaaagtgcacagaagggctgcgcttgaaaacttggatcttatcttcttatgccttgacgaagttgttgatggagggtaattactatgtttgcattgcaatatgctaacctttgctttccatcaattgaacaagcccagttttgataactatcacatttttacgttcatatcaaaggcaacagacaaggtcttgggcttgtattgctgaaatgtgaggttaggcactagttggttaatgtaaagaaactacactctggccttgtttaggtgatgagaattgagccagaattttacacaaaatcagcattgacagctatcagttatctataatatttttatagttcattgttgggtatgctcagttcacagccaaccaattttcagataaacatttgcacaaatgctatgctaatgtagaacatctacaatcaggcatattaaacatttgacaacctgtagttattgattgacgctactaattgtttcttcacaatcgggttttgcaggattgttctggaaacagatgcaaaggcgattcttgaaaaggtatcaggtcatggattggaaggatccgggtctctcactgagcagaagttaagcagtgccctagcaacggcaagagaacactttgcgagatctattttcagctgatggcgtgtcatccttcaggttgacgatgagcaagcctcagatagtgtctctgttagcagatcagtactcccagtttgcaatgtcctttgaacatttgccacgggttagtggtaggtgcagcttaactggcgatcattgtcatcctaagaaggttgtggtcggcacacttgttactcttgtggtttcatgtcgatcttggctgtaatcgagcacagtaaccatgtagcaacatgtttctgctcaaagacgagccagtttccaaattgtcttcagtatacagccgccatgttttgacgtagtactacatacatttacttcggcctggtttggaatttgaatggtattcttt

SEQ ID NO: 755 - DNA, 2070 bp, Oryza sativa
agcagtgaagcgtacagccgagctaccaccactctccggcgccggcgagcggcggacacggcgacggcgatgggtcgcctccgccgcggcggggtcggtctcctgcgtggtgccgtggtgctcgcgtcccttctcctcgtcgtctccggcgaagtcatcttcgaggagcgattcgatgatgattggggaagcagatgggtgaaatctgactggaaaaagagcgaagggaaagccgggacattcaaacatacagcagggagctattctggagatcctgacgatagaggtatacaaacaacctcggatgctaagcattttgctatatcggccaagttcccagaattcagtaacaagaaccggacattggtggttcagtattcgataaagattgagcaggatattgaatgtggtggtgcttatatcaagcttatgtctggctatgtgaatcagaagaaatttggcggtgacactccttatagcttcatgtttgggcctgatatatgtggtgatcagacaaagaaactccatctgatactgtcttaccaagggcaaaactaccctataaagaaagatctgaaatgtgaaactgacaagttgacacatttttacacattcattcttaggccagatgcctcttatagtctacttgttgataaccgggagagagaatttggtagtatgtacactgactgggacatcctccctcctcgcaagatcaaagaatctaatgcgaagaagccaaaagattgggatgacagggaatatattgaagatcctgatgaagttaaaccagagggctatgactctattcctaaagagattcctgatccaaaggacaaaaaggtttgcacttaagaattacgctgtaaatccagcttctaatattttcgcatttaattggcatatccgtttataatggacatagtgtcatatgttcttaatattatgagaagaacccgagtgcagacaaaggttccattttacctgttcaagcttgtttcattagaaacatcctatggcatgttagcattttctatctgctattagctatattgaacccagcatgacctcaatggctcttatggtgtgtttgctaagttaataaatataacacaggatgacatatgttttcctttctacactaaatcagcctgagtcatgggatgatgatgatgatggtgtatggaagcctagaatgataccgaatccagaatacaagggacgttggaaacgcaagaaaattaagaaccctaactacaagggaaaatggaagatcccatggattgataatccagaatttgaggacgacccagacctatatgtgctgaaacctttgcagtatgtgggaattgaggtttggcaggtgaaagctggttcagtttttgacaacattttgatttgtgacgacccggagtatgcaagaagtgttgttgatgaagttagggctgcaaataaagaggctgaaaaggaggccttcgaggaggctgaaaagcggaggaaggctagagaagacgaggaggctcggcgtgcacgagaggaaggagagaaacgaagaagagacagggatcggcaccgaggcagggaccgttacagggatagatatagaggtcatcatcgtaggtatgactaccatgacgagctatgaggtctccagattatcccattctttcaaggaacttcaggaagttagtgttgcccatcgactatttcatcacccaattgatgattgtaccaataaaatagaacatgttatttcgaggacagaacaaagctttatttcaggtgtggatagcacactacaacacgaactgatgctgttcacctgaaaccaagtaacaaactgaagatgtgaaagctagaacgtacatttttgggcagtaacaatatgctagcgaagaggacgatatgtttccatcttccagtaatatttctccttattagtgccttagaacatagaaaataaatcactctaggttgtgaaatataaactgtactttcattgtacttcagttatatatatctggcagtgtgtgttactaatgttcagagagtaatgttttcctttcttct

SEQ ID NO: 756 - DNA, 1331 bp, Oryza sativa
gggcggggaagaggagcgtctacctgatggactgcgcgccggtgtggggctgcgcgtcgacgcgcggccgcagcgcggagatggaggacgcgagcgccgccgtgccgcggttcgcggacgtgccggtgcggctgctcgccagccggcgcgacctcgacgcgctgggcctcgacgccgacgcgctccgcctgccggcgcacctcttcggcgtgttcgacggccacggcggcgccgaggtggcgaactactgccgtgaaaggatccacgtcgtcttgagcgaggagctgaagcgacttggcaagaatttgggggagatgggcgaggtggacatgaaagagcactgggatgatgtgttcacgaaatgtttccagagagtggacgatgaggtttcagggagagtgaccagggttgtcaatggtggcggtgaggtccggtcagaaccggtgaccgcagagaacgtcggctcgacggcggtcgttgcgcttgtctgctcatctcatgtggtggttgccaactgtggagattcgcgcatcgtgctctgccgcgggaaggagcccgtagccttgtcaattgatcacaagcctgacaggaaggatgagcgggcaaggattgaagcccagggaggcaaggtcatccaatggaatggttaccgggtgtccggtatacttgctatgtcccgatcaatcggtgatcgctatctgaaaccatttgtcattccaaaaccggaagttatggtcgttccacgggcgaaggatgatgactgtcttattctagcaagcgatgggctgtgggatgttgtgtcaaatgaagaggcatgcaaagtcgcacgccgacagatccttctgtggcacaagaacaatggcgctgcatcaccattgtctgatgagggtgaaggatccaccgaccctgctgcccaagcagctgccgattatctgatgagactcgctctgaagaaaggcagcgaggataacatcactgtcattgttgtcgacttgaaaccgcgaaagaaactcaagaacatttcataacagggcctgggttcatcttgagtagctgaccatgatgtgtgtcaaagagtttcatacaactagtcggtcttcctcacgggacttgacccactgttttttttgctgggcttcaagaaattgtacatgtatatgctagatgtatcttccatctagggataaatatctacctacctccattctatcccgtcagcttcagttttcagccctggcaagaagtatcccttgtacaataattgaacttggaaaaagctaagtggctgagatgaccagtaaaattaacataattgtgatcacctttcctga

SEQ ID NO: 757 - DNA, 1646 bp, Oryza sativa
cattgcatcggaatgcttgcagctttaccgagccaccggagtagcctcgtcttctccggcgagccaccggcgatgggaagtcgcagcggcggccgccaccgactcttcctccgattcatcgccctctggtcgctgctcctcatcgccgccggggaggtcatcttcgaggagcgcttcgaagatggttgggagtcccgctgggtgaagtctgattggaaaaggagcgaagggaaagctggaacgttcaaacacacggcaggaagatattctggagatcctgatgacaaagacaacgttggacgccaggcattttgctatatcggccaagatccccgaattcagtaacaagggccgtacattggtactccagtattccataaagtttgagcaggatattgaatgtggtggtggatatattaaacttatgtctggttatgtcaaccagaagaaatttagtggagacactccatacagcttaatgtttgggccagatatatgcggaactcaaacgaagaagctccatcttatactttcttatcaagggcagaactaccctatcaagaaagatctgcaatgtgaaacagacaagttgacgcatgtttacacattcatactaaggcctgatgcgtcctatagcatactagttgataaccgtgaaagagaatcagggagcatgtacactgactgggacatcctccctcctcgcaagattaaggatgttcatgccaaaaagcctaaggattgggatgacagagaatatattgaggatccagatgcagttaaaccagagggctatgattctattccaaaggagattcctgatccaaaagacaaaaagcctgacacgtgggatgatgatgatgatggcatatggaagcctagaatgataccaaatccagcatacaagggaccatggaagcgcaagaaaatcaagaatcctaactacaagggtaaatggaagatcccatggattgataatccagagtttgaggatgatccagacctatatgtgctgaaacccttgaaatatattggaattgaggtttggcaggtaaaggctggttcggtttttgacaacatcctcatttgtgacgatccggaatatgcaagaaaagctgctgaggaaacatggggtgcaaacagggaggccgaaaaagaggcttttgaagaagctgagaaggagaggaaagctagagaggataaggaagctgaacgagcaagggaggaaggagagcgacggaggagagagaggggtgatcggcaccgtggcagggattacaaggacagatacaaaagacgtcatagggatcactgggatgatgactaccatgatgagctttgaaatcacggaaaaatgctttcttcctaggagaagctggaatttgcatggtcattgcttataattgttaccaataaatgatctgggaggccagaatagccgcaagtgttccttgctgcgtgtgctgaaaatttgaatatccggattggaatgaaatgaacaaaagcctgaagatcattccttttggacagcagggcatacgattctacttaccagcaacacgttgtttttagttgtgaattggtgaaatgttgacgttgtaacgttgcgacttgcgaatataatgtgcacggggtgatgttctgcc

SEQ ID NO: 758 - DNA, 2972 bp, Oryza sativa
atccctgtttgagatcatccctgcaccaaaaatccaactcataaagaaattcatattttgcaagtgaaattgtgggaacaaaaggaaaaaaagcccaaagccaaaagccaaagccaaaggcaagacagattgtgacagattccatatattgttttgattgtttgctcctatctctaaggaactctccaacctgaaaggattccaacttgaaaccaaagcttgctgcttcttttctctcatttgtctgaaattcatccattttttcagtagacaaggcaagaaaaggcaagttgtgcaaagttttgttcttcagattagcttggaggcaggcaaaagaaaaaaataaggcgccaaactttgtgtgctcctggatcataggaagaaatatccaagagattggtaaaaaaaggcgccatttttgagagaaaggcgtctccttgcgatcaagctggtgatgtgatcgaagagtagaggcggcgatggaggcggcggagctggtgaagaagatacgggagctggaggagggccaggccgagctcaagcgggagatatccaggatcgtgccggagcgcggcggcgcgcggcggccgccgacgctgcccgcgcagcagaggcgcaccgcgctcccgcaggcggcggcggcggcgccgtcgtcgcggctcctgcagcgcgtgggccgcgccggactccccgaccggcactacgtcaggatcctgcactcgctggggcaggccgtgcacgtcatctccctcgacggcaagctcatgtattggaaccggtacgcggagcatctgtacggctattctgttcctgaagcagttggtcaggatgcccttgaattaattgttcatcctagtgactatggtgcagcaaacgacatcatacagaatatattcatggggaagtgttggagagggaaatttccagttaaacacaagtcaggggagcgtttcaacatcgtcgccagtaacacgcctttgtatgatgatgatggtagcttggtaggcctcatctgtctctcaactgatacgcggacattggaggagatacttggccattcaacctcagggaaagtgtatccgagttcagcaaagccgcgcgttcaactcaatgggtccaaaagtggtttgctaaacaaagtttcttgtgactcccagcaacctcttcaatctgctatcacctccaggataacaaatttgagtaacaaacacaggctaccagggttacaaatagagttcgctctcgggtcaagacgggtcagaattgcgatgatcagttcggtggtgcctgtgagagccattattctgaacatgatgccagagaagagcagacatctagtgaaggaagcaccccaagtggggatgttcttcatggggcctttgttagtgaagacaattactctgggaagtcaagcaaaacaaacagtgatgactcaggagaaggaaaactggggcttcacaaaattcttagctcaacagcagaggcactgtgggccaacaggggaattccatggccttggagaggtcatggaaatgatgatgctgggaagaatcgaacgaacttgccacagttccatgaaattcaagagaatggacagagccataaggaagttccagagccaatcatactaccagactgccaagatactgaatttgtccaggaagtcaaatatgaggtttcaggttcctggtggtctttcaatgccagcacaagtagtatgagcagtactggaagcactaatagcagtgctatcgagagagcagatcgtgaagcagactgcctggattttgaaattctgtgggaagacctggcaattggagaacaagttggtcaaggttcttgtggaacagtgtatcatgctctgtggtatggttcggatgtggcagttaaagtattctccaaatatgaatactcagaagacatgatactcaccttcaggcaagaggtagcattgatgaagaaactacgccaccccaatgtgatactcttcatgggtgcagttgcgtctctccaacgactttgcattgttacggagtttctgccacgagggagtttgtttcgcttacttcaaaagaatgctggcaagctggatccaagacggcgagttcacatggctatagacattgcaagaggcatgaattatctccacaattccagcccacctattgtccatcgtgatttaaaatcatcaaaccttttggtcgataagaactggactgttaaggttgcggactttggtctttcacgtctcaaactcgaaacatttctgacaacaaaaactggaaaaggaacaccacaatggatggctccagaggtattacgtaatgaaccttcaaatgaaaactacggagttatcctatgggaaattgctactcagaagataccatgggataatctcaatacaatgcaggttgttggagcagtggggttcatggaccacaggttggacattccaagcgatgttgatcctcattgggcgtcgatgatcgagagttgctgggacagtgacccgcagcgtcgcccttcgttccaagaactgctagatcagctccgagatctgcagaagcaatacaacttgcaggctcaactgcagcgaactgcagctgccaagatgagtgttgacgattgctaacttcaaaatctgaatggtccatgttcagcttgttgccaatatgaggtcccagcaggccagcaaaatgggattcgttaggagtccagtctaaccaaaaagggttctgaattctgaacattttgctacttttctgaagaagctgtggcagcaattgagtttgtgccagaaaaagatggtgcattcgatctgaagcctgaagctctgcaactgcaattcaatcaatcttccagcagtgatgaccgatgaaatttcggcagtcatcgaatacaatgctgtattcaccctattaaccatgtacatgattttttttaaaaagaaaaggttgttgttggtattctgc

SEQ ID NO: 759 - DNA, 390 bp, Secale cereale
gttcgagatcgaccaagaatgggatgacaaggaagatggcaacgaagctgtccagcaatgggaggatgactgggatgatgacgacgtgaacgatgatttctcactgcagctgaggaaagagctggagggaggcaacactcagaagagctgaactacttccccatccatatcaaagctgtagcacactttatcttcaatcaggcactgtgtggccattgctatctgaacctgtgatacttccctagcgatatcaagctctgatactttatcttcgtttcagcactgtgtcgtaccgtactgcatgtagctatcggctgcgagccgcacaacttgccgaacagtgatagttcccagacagtatcgcaattatcagaaagtttgtggacatgc

SEQ ID NO: 760 - DNA, 928 bp, Secale cereale
acgacggcggcgcggccgacgtgggcgccggcgaagggcgggaacgagcagggcggcacgcgcatcttcgggccctccgggaagtactcctcccgcgacctcgccgcccacacctccctcaagcscaraaaasaggacaacaaactcaagaggaggtrcagaagaggaatcttagggacgaacttgaggagcgtgaacgcaagcacttctcatccaaggataagtcctatgttgacgatagggaccggcgaaaaagttcaagcctgctcttagaaggktcaaaacgggatgaggataagatagttccacgtgaaattgatgcagatgactctgacgtggaactcaaaagtgatgatgaaagcgacgacgatgatgacgacgacgacactgaggcactaatggcagagcttgaaaggattaagaaagaaagagccgaagacaggcttagaaaggagcgtcagcaagcagaagaagaggccaagatgaaggaggctgagctgatgcgaggaaacccactgatcaatatgaataactccggctccttcaaygtgaagagaaggtgggatgatgatgttgtattcaagaaccaggctcgtggagagaccaagacaccgaaacggttcatcaacgacaccatcagaagtgatttccaccgcaagtytctgcataggtacatgaaatgatgytgctgtacgctttatgttgtctggacagtatgcatgctgaaagagcctgtgatgtttctgtattctgaagatcgatttgtatgacataactgtaacagctatgttatcttaatggtgatatgtttaccctgttcctaagagtaaagaaaagaacccactgctggtgtattactgatgcttcgctgtgacctcaggatgtttctattagtacattgacctggaaaatatgtatgcttgccgtg

SEQ ID NO: 761 - DNA, 1415 bp, Carthamus tinctorius
cagtagaacacaacaaatcactctcaatcccattaaatcttcaatcacaacaacaacaatcgtggctgattgctattcaaacccttaagattctggaaccagattgatatcatcatcatttctttcgccacaagttaaaccctactgtagatcaagttcaagttcagcaccttctttcaactctacacagtattataatgacgtcgaggaagatgctgatcgatggggatgttggtgagaatactgaagatatacagtatgattttgatttgtttgtaattggtgctggtagtggcggtgttagggcatccagattttcagctcagtatggagctaaggttggcatttgcgagctcccatttcatccagtcagctcagaagtcataggaggtgttggaggaacatgtgtgattcgcgggtgcgttcctaaaaagattctggtctacggagcaagctttgggcctgaaattcaggattcaagggaatatggatggcaagtgaatgagaagattgattttgattggaaaaagttactgcacaagaagactgaggaaatactgaggctaaatgggatatacaagcgcttactttcaaatgcgggagtgaaactgtttgaaggggaggggagaatcgtgggccctaatgaagtggaagtgatacaattggatggcactaaactgtcctatacagcaaagcacatactgatagcaactggtagcagggcggcacgtgtagctattcctgggcaggagttggctataacctcagatgaggcgttgagtttggaggagttaccaaagcgcgttgttatacttgggggagggtatattgctgttgagtttgcttcaatatggcgtgggatgggctccacagtgaatctatgcttcagaaaggaacttccattaaggggttttgatgatgaaatgagagctctggttgcaagaaatctggaaggaagaggcataattttgcacccacagactaacttgactgagctggtcaaaacggaggatggcataaaagttactacagatcatggtgaagaattaatggcagatgctgtacttttcgccactgggcggctccctaatacaaagaggttaaatttgcaagccgtaggtgttgaagttgacagtgcaggagcagtgaaggttgatgagttctctcgcaccaatgtgcctagcatttgggccataggtgatgccaccaatcgtatgaatcttactccagtcgccttgatggaagggactttgttcgctaaaacagtcttcggtaatgaacctagcaagcctgactacagcaatataccttgtgccgttttctgcatcccacctctctctgttgttggagtaagtgaagaagaggccatagagaaagctcaaggagatattttggtgttcacatcaacatttaat

SEQ ID NO: 762 - DNA, 847 bp, Carthamus tinctorius
cggggcattcccaatttgccattttacctactgtctgctaaagatgagcaaccatggagttggaaggtcttcgtctctatctctcatctttggggcacttctatttgttctagtctccatctgtgatttctcctgctcagagatcatcttcgaggagcgatttggagatgggtggcagagccggtgggtgaagtctgattggaaaagaagtgaagggaaggcgggttcttttaagcacacagctgggtcatggtctggtgatccagatgataaaggtattcagacatcgactgatgccagacattttgccatatctgcaaagattccagaattcaacaacaaaaatagaacattggtattacagtactcaatcaaaattgaacaggatatcgaatgtggtggtggttatatcaagcttatgtctggatatgtcaaccaaaagaaatttggtggtgacactccatatagtgtgatgtttggaccagatctatgtggcacacagacaaagaagcttcatgttatcctttcctaccaggggcaaaattatcctatcaagaaggatctacagtgtgaaacagacaagttaacccatttctacacattcatccttaggcctgatgcaagttatagcattctaatagatggcagggaaagagattctggaagtatgtatacagactgggatatccttccaccccgtaaaatcaaagacgtgaaggccaaaaagcctgctgattgggaggaacgagaatatattgaagatccagaccaagttaagcctgagggctatgattcaatcccgagagagattcctgacccaaaagctaaacagcctgatacctgggac

SEQ ID NO: 763 - DNA, 492 bp, Carthamus tinctorius
taggcgggggtcagacgctttatcttcgtgagtcttcttcttcacattctaatccaactggaatttcttctgaatccttgtgttcatacttgaggcaaatatggcgacaacggagcaacaaccgaaagcagcagcaactgaagaagctaagattgatctgttcgaagatgacgacgagtttgaagagtttgaaatcgatcaagattgggatgtcaaggaggaagggaaagaagtaacgcaacagtgggaagacgattgggatgacgatgatgtgaatgatgacttctctctgcagctgaggaaggaactcgaaagcaacaccgagaaaaagtaagtgaaatctacaaatctagcatcgttttcatattcgagacagatttcttgttagccaatgtacgctaagattttatacattcgacttcagttctatgtcaaatgaatgtataactactcttgttgatggtgtttaaatcgtrttatgagaccaaaaaa

SEQ ID NO: 764 - DNA, 832 bp, Carthamus tinctorius
  misc_feature (720)..(720): n is a, c, g, or t
cacacaagcagcgctagcagttgtggaagcacgaacagtagcgccattaataaagtggacatggacaccgatagcttggattatgaaatcttgtgggaagatttgataattggagaacagattggccaaggttcatgtgggacggtttatcatgcaatgtggtatggatcggatgtggctgtcaaggttttctcgaggcaagaatattcagaggatgtgatactatcgtttcgacaagaggtttccctcatgaaaaggcttcggcatccaaacattctactcttcatgggtgccgtaacctcacctcaacgtctatgtattgtcacagagttccttccccgtggaagtttgttccggttacttcaacgaaatacaactagattagattggagacggcgtgttcatatggccatggatatagcacgtggcatgaattatcttcatcattgtcacccgcctattattcaccgggatttgaagtcttccaatcttctcgttgataagaactggaatgttaaggttggcgactttggtctctcgcgtatcaagcatgaaacataccttacgacaaagacggggaagggaacgcctcaatggatggctcccgaagttcttcggaatgaacaggcagacgagaagtccgacgtatacagcttcggtgtggtgttatgggaaattacgaccgagaagatcccttgggatagtctcaactcaatgcangtaatcggagctgtaggtttcatgaatcaacggctagatatcccaaaagacgtgaacccccaaatggccgagcttattgaaagctgttgttgcagtgaacccgcatcgcgac

SEQ ID NO: 765 - DNA, 957 bp, Carthamus tinctorius
gcgggggtccgtttctttgccttgcatcgccggcaatccatacctgctctctctcatcaccacacccttcaattctctctctgtaaatcccatcatcatcatatcacctcaccccccttttcattcaattcaattctctcaccacctcactcctcgccctaattttcgcaattttatcaaactccgatcaccgtatttttgcaggaaggaggataaaggctctccgcaattccactttcttggatcgagagaccctgctgctcccatcgagagattgtagataagaagcaatgagttttcaagatattgaagctggccgcccactcaattcgagacgtggtggtggattgaacaatggcatcaggaaacaggatccgactcaggcggttgcttctggaatcttccagatcaacactgcagtctccacgtttcagaggctagtgaacacgcttggcactcccaaggacacacctgagcttcgagaaaagctgcacaagactagactacatattgggcaattggtgaaggatacttcagagaaactcaagcaagcaagtgaaacagatcatcgtgcggatgttagtgccagcaaaaagatcacagatgctaaacttgcaaaggactttcaagcagttctaaaagaatttcaaaaggcacagcggctttcagctgaaagagagacggcttacacaccttttgttcctcaagctgcttatccttcaagtgatcccgccaatgaaatggatgcaagctcaggtaaaagtcaagaacagcgtgctcttcttgtggacaataaaaggcaggaggttttgctgttggacaatgagattgcattcaatgaagctattatcgaggaaagagatcaaggaatacaagaaatccagaaccaaatcggtgaggtaaacgaaatattcaaagatcctgctgttttggttcacgagcaaggaactatgatcg

SEQ ID NO: 766 - DNA, 1204 bp, Carthamus tinctorius
aacccttctcattcattcacttgattgcttttgtgtcaattcattctctcccaaattccatcatcaaccaaaccctctctcttctgatcgccaaaacctcctctaattctcacccccttccgatcgaccaccctgctcgatcgatagggtttcatctcagttggaagaatttttcaatttagggttttaagatgagctttcaagatcttgaagcgggtcgacctctcaattcaaagcgagttggatacgtcaatggcggaaggcagcaagatcctacacaagctattgcttccgggatcttccagatcaataccgccgtctccacgtttcagcggctggtcaatacccttggtacacctaaagatacccccgaacttcgagaaaagctgcataaaacaagactacatattgggcaattggtgaaggatacttcagataaactcaagcaagccagtgaagccgatcaccggtcccaagttagtgccagcaagaaaattacagatgctaaacttgcaaaagattttcaagcagttctaaaagaatttcagaaggcccagcgcctgtcagctgaaagggagacggcgtacactccttttactcctcaagccgttcttccatcaagttatgcagccagtgaaatggatgtaagctcaaacaaaggtcaggaacagcatgcccttcttatggaaactaggcaggaggttttgctgttggacaatgagattgcgttcaatgaggctattatcgaggaaagggaacaagggatacaagatatccagaaccaaattggtgaggttaacgagatattcaaagatcttgctgttttggttcatgagcaaggagctatgatcgatgacattggctccaacattgaaaattctcatgctgctactgcacaggcaagagtccaactttcaaaagcatccaaaacccagagggcaaactcctccatgacttgcttgcttttggtgatagtcgggatcgtccttctcattgtgatcataatccttgcagtttgatctcaaactgttgtgcgtatagataaaactgaagccttgtgtatggatttgatatgcttcctttgagcatcttgtgttctactaagattgatttcttctttgggtcatagtgtgataacatacttcgaaaattatatttgtttgcagggattctttgtgtacaatcaacaagttctctttgtttt

SEQ ID NO: 767 - DNA, 442 bp, Carthamus tinctorius
gtctagcaatccttcattcatcggaacttctttttggatcctcgtgttcgtaagaatggcgacaactgaacaaccgaaggttgctgctaccgaagaagctaagattgatctgtttgaagacgatgatgagtttgaagagtttgaaattgatcatgagtgggatgtgaaggaagaaggaaaggaagtaagtcaacaatgggaagatgattgggatgatgatgatgtgaatgatgacttctctcttcagctaaggagggaactggaaagcaacactgagaagaagtgaatgaaatctgcataggtaatcaaactccatttcaaagtgattgtcctttttggtataaaatctagacttgtggatttcttcatcgtatgaacctttcatttcataattgttgcgttcgccgatcaagaatatgaaatcctttcactttcgtgattc

SEQ ID NO: 768 - DNA, 1333 bp, Sorghum bicolor
tggagaaagaatccaactcgccattgctgaaccggaataaaagataagcccagcgcctcttcatttacgcacgcccagacgacgaccaaaggaaggggaaagaggaggagagcgacaacagcacctcgagcaaattgaagcaggttttgtgttgattcggagtggagatttgaggcctgcggcgacgatggcacctgcgaaatccggggagaaggcgaccagcttcgccatggcctgcagcctgctcagccgctacgtcaggcagaacggcgccgccgccggcgatctcggcctcgccatcagagctgaagccgatggaaagagggcgtcggcagacacggaaaagggggacacgacgaaggagaccatggatctattccctcagaacgctgggttcggctcggaggctgccatgaaggaagcccctgatgtgagggagccagagaagcgccagctgactatcttctatggcgggaaggtccttgtgttcaatgacttccctgctgagaaagcaaaagacctgatgcaaatggccagcaagggttcgtctgtagctcagaaccctggcatgctgccttcccccacagttgcaacagttactgacagcaccaagatcacagcagtgccagccgcaccaattgctgtggtcaatgcccaaaagagtccagcagatataccccaggctcccaaggcatctcttcgccggttccttgagaagagaaaggatcgccttaccgcgaaagcaccataccaaggttccccttcagatgctacacctgtgaagaaggagatggcggagggtcagccatggcttgggctgggacctcagatcgccaatcctgatctgagcttgtgcaaggaggggagccaatgatcgacaatccagcatcaccatcttcaaaactgcgatactcaacagtcatgtgtcaaagtgttctgttttgggcctattgttccgtgtgtttttcgcgtggatacgtaggttgtacgaatgtaaaggacgtagctaaagatggacttgactaaggattaccggtgctggggcaggtttgctggctgatcagcgtgtggtggcctgacccaaatggccatgttagaaagatgaaactgtaatgtagttgctagaacaagttcatattttgggatgttctgtgttgtttggctttggcactggtgtgtgtcacaaagctatttattgtaacagatacatcccgtatgattgttttatttttattttcatgttatactcttaatcttctggttgtctctgtaagtctgtacggtcaatgtccctggactataaaaatgctgatctccaaagttataatttact

SEQ ID NO: 769 - DNA, 2061 bp, Sorghum bicolor
acccggggtctgggtcgcgtcgcgtctcatcattttcccctcgtgcgctctctcgaaccttccaaagcccccgaaccctagtgagctcggaaccctagccgcgcgcggatctcggcttgcttgccccctcctccacgccagccatggatgacgacttcgagatgccgaccgccggcgccgacgagatgatgggcgacgacgagatgggcgacttcggcggcgatgagggcccggtgttgaaggtgggcgaggagaaggaggtcggcaagcaggggctcaagaagaagctgctcaaggagggcgagggctgggagacgcccgaggtcggcgacgaggttgaagtgcattacacgggtacactccttgatggaacaaagtttgactcaagccgtgatcgcggagatcctttcaagttcaagcttggacaaggtcaagtgataaagggttgggatcaaggcatcaagaccatgaagaaaggagaaaatgctgtttttaccattcctccagaactggcttatggagcatctggttcaccgccaactattccaccaaatgcaaccctgcagtttgatgttgagctgctttcatggaccagtgtcaaagatatttgcaaagatggcggcatattcaagaagattcttaaagagggggagaagtgggagaacccaaaggatcctgatgaagtacttgtgaaatatgaggcccgtctcgaagatggtactgttgtatccaagtctgagggggttgagttcactgtaaaagatgggtacttttgtcctgccctggccaaagctgtcaagaccatgaaaaaggcagagaaggtgctccttacagtaaagccacaatatggatttggcgagaaaggtagaccagcagctggagaggaaggtggtgtgccaccaaatgccactctgcacattgaccttgagttggtttcgtggaagactgtcacagaaattggtgatgataagaaaatccttaagaaggttctcaaggagggagaaggttatgagcgtcccaacgagggtgccgttgttgaagtcaaaattaccggaaagcttcaggatggcacagtgtttacaaagaaggggcatgacgaagagccatttaaattcaagaccgatgaagaggaagttatagatggtcttgatcgtgctgtattgaacatgaagaagggtgaggttgctcttgtcacgattcctcctgaatatgcatttggttcaactgagtcaaagcaggatcttgctgttgttccacctaacagcacagtggtctacgaagttgaacttgtttcatttgtgaaggacaaggagtcgtgggacttaaacaatgaagagaagattgaggctgctggtaagaagaaagaggaagggaatgcattgttcaaattgggcaaatatgctagagcttccaagcgatatgagaaggccgccaagtacattgagtatgaaagttcattcagtgaagatgagaagaagcaatccaagcaactgaagatcagctgcaacttaaacaatgctgcctgcaaactgaagttgaaggactacaaggaagctgcgaagctttgcaccaaggttctggagctagatagccaaaatgtcaaggctctctacaggagggtgcaagcgtacattcaacttgctgacctagagctagcagaggccgatatcaagaaggcactggaaatcgatcctaacaacagggatgtgaagttggaatacaagaccctgaaggagaagatcaaggagtacaacaagaaggacgcgaaattctacagcaacatgttcgctaagatgacaaaatggcttcttgggtagaggatgtagtgaagcaaaggattacaagcaatgccattttctgctgcccaaggacttcgcctgttgcttaacattcaacctttggcatactttgtagtcaattagcgcgcatggatgcttggatatgtgaaactgaggaacaattacttcgaggattattattggctctgaatctttctgtttttttggttcttgttaggaccattgattctgtcgtttaagaatcttatgcatttcacacaca

SEQ ID NO: 770 - DNA, 1995 bp, Sorghum bicolor
gtacaaaacttaaacagaagaaggcgaggcggaatcgcagtcgctcaaggtcacggcctcacaggtgactcacgaatcgagctacaggagagggaagcttcaggaaacgaagccgagaggagcgaaccttctggttcgtctgcgctgcgtatcaagatcacagggttgtgcttgaatcgcgggcgttgggaacccatccatggcgaggaagatgcttgtcgacggggaggtggcggccgtcgcggacgccgggcagtacgactacgatctgttcgtcatcggggcgggcagcggcggcgttcgcggctctcgcttcgccgcctccttcggagctaaggttgcgatttgtgagctcccattccaccccatcagctcagagtggctaggaggacatggtgggacgtaagcatctcctaaatgttttcttgcatttcttgtgcttactcaaaacattcagctaatctgctaggtatattgctccattctaaatctgcatgctcataatgatcatattgttgtcctaggtgtgtgatacgtggttgcgtacccaaaaagatactcgtgtacggtgcatctttcggtggagagtttgaggattcaaagaatttcgggtgggagattaatggggatattaacttcaattggaaaaagctgttggaaaataagactaaagaaattgttagattaaatggagtatatcagaggatccttaccaatgctggtgtgacaatgattgaaggggcaggcagtctagttgatgctcatactgttgaagttagccagcccgatggttcaaagcaaaggtatacagcgaagcacattttgattgcgactggtagccatgctcaacgtgtcaacatacctggaaaggagctggctattacatcagatgaggccttgagcttggaggagcttccaaagcgtgctgtaatcctcggtggcggatatattgctgttgaatttgcttctatctggagagggatgggtgctgaagtagatttgttttatcgaagggagcttcctctaagaggttttgatgatgagatgagaactgttgttgcaagcaaccttgagggaaggggaatcaaattgcatccagggacaaatctgtctgagttaagtaaaacggctgatggcataaaagttgtaactgataaaggagaagagctcattgcagatgttgttctatttgcgacagggcgcacaccaaactcccagagattgaacttgcaagctgcaggcgtcgaggttgaccagattggtgccatcaaggttgacgaatattctcgtacatctgctcctagtgtatgggctgtgggtgatgtaacaaaccggatcaatctaacacctgttgcattgatggaggcaacttgctttgccaaaactgtgtttggtggccaggaagttaagcctgactatggagatgttccttgtgctgttttctccattccaccactatccgtagtgggcctcagcgaacaacaggccttggaggaagccaatggtgatattcttgttttcacttcatcattcaacccaatgaagaacagcatatccaagcgccaggagaagactgtcatgaaactggtagttgatgctgaaactgatagagtacttggtgcatccatgtgtggaccagatgcacctgaaattatccagggcattgctattgcgcttaaatgtggagccaccaaagcgaacttcgacagcactgtcggaatccacccttctgctgctgaagagttcgtgaccatgcggactgtgacaaggcgcgtgagcccgacatccaagccaaagacaaacttgtaagcaagagttgatgttctggggaatgttacacaacacaaatattctggtttcattttggtaattctacgtcattcaaactggaacactgtatattgaaggaatagggtttttgcatgacagtccacacaaaataatgaaagctcaagctgaggcctgaggatgttcatggttgcattggttctctgc

SEQ ID NO: 771 - DNA, 1104 bp, Sorghum bicolor
ctctcctcgctgtttcggagccccggggccggggggaaggccaacccgaccgtcccaccgcgtcgtctccctcctcgtctcctctcctctcctctcgcgtccgcagcttcccttgcaggctagggtttgcagatgacgacggcggcgcgccccacctgggcgccggccaagggcggcaacgagcaggggggcacccgcatcttcggcccctcccagaagtactcctcccgcgacctcgccgcgcacacctccctcaagcccagaaaagatggtcaacagacccaagaggagttacagaagaggaacctcagggaggaacttgaggaacgcgagcgcaagcactactcttccaaggataagtcctattctgaagaaagagaccggcggaaaagctcaagccagctactcttagaaggttcaaagagagaggcagaggataagatagttccacgagaaatcgatgcagatgactctgatgtggagcctaaaagtgatgatgagagtgatgaagatgatgacgacgacgacgacactgaagctctaatggcagagcttgagaggattaagaaagaaagagctgaggagaagcttagaaaggagcggcaacaagcagaagaggaggccaagatgaaggaggctgaactgatgcggggaaaccctttgattaatatcaacaatcctggctccttcagtgttaagagaaggtgggacgatgatgtggttttcaagaaccaagcacgtggagagaccaagacaccgaaacggttcatcaatgataccatcaggagtgatttccaccgtaaatttcttcagaggtacatgaagtgatggtaccgctgtgtacaacttacatgtctccgctccttgtatgggagagcattggttcagttgggagctcttatcgttgttatgtttgtgtacgagtgaaagaccagcatagcattggttcagttgagagctctcatcgtgttaagtttgtgtacgagtgaaaggccattattgtgttgctgtatgaaacaaaagtataaacatctgtcggcatcttaacaaagctgtactgagcaatacatatcttatctgaatgtgccaaggtcctatttttct

SEQ ID NO: 772 - DNA, 1286 bp, Sorghum bicolor
cttttccatcgtctccccaagtccggtcgtgctccgtcttcgtctacctctcgactctgaatagatagcaatctccaaatccccaagagcccccggccggtcaaattagggtttcttcctgcttgcttcacagggccgtccagtttgcgggttctgtcggtggcgcttgcgatggagggcttctgggacgcgcaatcgcagcggaggaggacgggcggcggtggcggcttcgaatcgctgaagcgtctgggtcacatctcacccgctgtgcagtcgcacctcaaacacgtttacctcaccctatgctccgcgctggtcttctctgcgctcggcgcctacctccacatcctcctcaacgtcggaggcaccctcacgaccgtcggatgcctggccgccatcgcctacctcatctccctgcccgcctcacgggaccaggagaggaaccgcttcgccctgctcatgtctgccgcgctccttcaaggcgcctccgttggcccgctcgtcgaccttgttattgacttcgatccgaggattctcgcgacggcgtttgtcggaactgcaattgcttttggatgcttctctggcgctgccatcatcgccaaccgcagggagtacctgtaccttggtggtctgctttcatctggcctctccattcttctctggctgcagtttgctacttcaatctttggccacaccagcaccaccttcatgatcgagctctacttcggcctcctggttttcctgggatatatggtgtttgacacccaggagatcattgagagggcgcacggtggggacatggactacatcaagcacgcactgactctcttcaccgactttgttgccgttcttgttcggattcttgtcatcatgatgaagaatgcgcaggagaaatccgaagacgagaagaagaggaagaagcgctagctgctgacccaactatcctatcttgttcctatgagaaaactcttgggactatgttggtggggtcttcccttgcctcctgagtttaccaaactattgaaactatgttgttggggtctccccttccttcctgagtttacctaactatgactattagtactactagtatcatgtgtgtagtttgtactgaagaccagaagaagctttgagcatgcacttgttacctgaatgaatgtaccgatgactgttggcaatgagtatttggtttggctattgttatgttgatttgctggtgatgatggatggtggatggacaatgaaaatgagtggtggagtcacttttctgtaaagttgggcgttcc

SEQ ID NO: 773 - DNA, 1053 bp, Sorghum bicolor
tgacactacccgttgggctcggctcgcgcggcgccgtcctcccccactctcccctcacacacacgcacgaacacacagcacgcgccgcacccccgcgctctcctctcctgcgaccaaatctgcgcggcgcgggagtgagcacactgagggcggtctcctcctcctcctccccgttcgcgagcggttcgtgtcccgagcgatccggcagccatgaacatcttcaagaagaaggtcgaccccaaagaggctctcaggaccagcaaacgtgagatggcggtcgccacgcggggagttgagcgagagattggttccctgcaaatggaggagaaaaagctggtcgcagagataaagaagactgccaagactggaaatgaggccgcaaccaaaatattagctcggcaacttgtcaggctgcggcaacaaatcctcaatttgcaaggcacacgggcacagattcgtggagtagctactcacacacaggcaatgtatgccggcacttcaatctctgctggaatgaaaggtgcaagcaaagctatggcagcaatgaataagcaaatggaaccggtgaagcagataaaggttatgaaagaattccagaaacaatcaacacaattggacatgacgctcgagatgatgtccgatgccattgatgaaacacttgacaaagatgaggcggaggaggaaacagaagagcttacaaaccaggtccttgacgagattggcgtggatgtggcttctcagctttcttcggctcctaaagggcgcatcggagcaactaacaagaaagtcgataacagtcacgcacgtaatcctgcagctcctgcgaggaacgtggcggcaccacccgaatcctctgctgaagtcgacgatctggagaggcgattggcatctctgcgccgtatctgagtctgagccgctgaagaaagaacttgtttgtaatactactagtagttattcatctatctatatgtgtaaagttgtttatatgtgtaaggaaacagcgaattgcaaatgatacggtttaataacctacctaatgctttatttattttg

SEQ ID NO: 774 - DNA, 876 bp, Sorghum bicolor
ccggtccggagccgaagaagccggagcgacaagacgacgggcaccgcagcttacctcgccgcgtagggtttccagatgacgacggcggcgcgccccacctgggcgccggccaagggcggcaacgagcaggggggcacccgcattttcggcccctcccagaagtactcctcccgcgacctcgccgcgcacacctccctcaagcccagaaaagacggacaacagacccaagaggagttacagaagaggaacctcagggaggaacttgaggaacgtgagcgcaagcactactcttccaaggataagtcatatgctgaagaaagagaccgacggaaaagttcaagccagctactcttagaagggtcaaagagagaggcggaggataagatagttccacgagaaattgatgcagatgattccgatgtggagcctaaaagtgatgacgaaaggatgacgatgatgatgacactgaagctctaatggcagagcttgagaggattaagaaagaaagagctgaggagaagcttagaaaggagcggcaacaagcagaagaggaggccaagatgaaggaggctgagctgatgcggggaaaccctttgatcaatatcaacaatcctagctccttcagtgttaagagaaggtgggacgatgatgtggtattcaagaaccaggcacgtggagagaccaagacaccgaaacggttcatcaacgacacgatcagaagcgatttccaccgcaaatttttgcagaggtacatgaagtgagctagtgcgggcgtgccgtgtacaatttaaacttctctgctgtttgtattgtgatgtttgtgtatgatgagtgaaagatcactattgggctgctgctgtatgaaactctgaagca

SEQ ID NO: 775 - DNA, 634 bp, Sorghum bicolor
ccggtccggagccgaagaagccggagcgacaagacgacgggcaccgcagcttacctcgccgcgtagggtttccagatgacgacggcggcgcgccccacctgggcgccggccaagggcggcaacgagcaggggggcacccgcattttcggcccctcccagaagtactcctcccgcgacctcgccgcgcacacctccctcaagcccagaaaagacggacaacagacccaagaggagttacagaagaggaacctcagggaggaacttgaggaacgtgagcgcaagcactactcttccaaggataagtcatatgctgaagaaagagaccgacggaaaagttcaagccagctactcttagaagggtcaaagagagaggcggaggataagatagttccacgagaaattgatgcagatgattccgatgtggagcctaaaagtgatgacgaaagcgatgacgatgatgacgatgatgatgacactgaagctctaatggcagagcttgagaggattaagaaagaaagagctgaggagaagcttagaaaggagcggcaacaagcagaagaggaggccaagatgaaggaggctgaactgatgcggggaaaccctttgatcagtatcaaccaccctggctccttca

SEQ ID NO: 776 - DNA, 1654 bp, Sorghum bicolor
acgcagcacgctgcggtaccgattagcgaagctcccccctccctcccggcgctccgcccgctccttgtccgctccggcgatgggaactcgccgcggcagcggcgtgctccaccgcctcctcgccctctcgtcgctgctgctcctcgcttccggtgagatcgtcttcgaggagcgcttcgaagatggttgggagagtcggtgggtagaatccgattggaaaaggagtgaagggaaagctggaaggttcaaacacacagcggggagatactctgcagatcctgatgacaaaggaatacaaacaacaatggatgctagacattttgctatctcagccaagttcccacaattcagtaacaagaaccggacacttgtggtccagtactccattaagtttgagcaggatattgaatgtggtggtggctatattaagcttatgtctggttatgtcaaccaaaaaaaatttagtggggacactccatacagcttgatgtttgggccagatatatgtggtactcaaacaaagaagctccatcttatagtctcttaccaggggcagaactatcccatcaagaaagatctagaatgtgagacggacaagttaacacatttctacactttcattcttaggcctgatgcgtcttatagcctacttgttgacaaccgcgaaagagaaactgggagcatgtacaccgattgggatatcctccctcctcgtaaaattaaggatcttcacgccaaaaggcctaaggactgggatgacagagaatatattgaagatcctgatgaagtaaagccagagggctatgattctatcccaaaacagattcctgatccgaaggccaaaaagcctgacacgtgggatgaggacgaggatggaatatggaagcccaggatggtatcgaatccagcatacaagggaccatggaaacgcaagagaattaaaaatcctaactacaagggtaaatggaagaccccatggatcgataatccagagtttgaggatgatccagatctttatgtgctgaagcctttgaagtatattggaattgaagtttggcaggtaaaagctggttcagttttcgacaacattttgatttgtgatgaccctgagtatgcaagaaatgttgttgaggaaacttggggtgctaatagggaggctgaaaaggaggcttttgaagaagctgaaaaggagaggaaagctagggaggatagggaaggtcaaaaggcaaaggatgatggtgggcgccgaaggcctcgtaaaaaacactacagagatcactgggatgactaccatgatgagctatgaagtccccaaagtattgcattcctcaaagcataagctggaagttgctttggacattgtggatacttttcaataataattgattcgcgaggcccgaacaacctgaagtgtttcttgctatgtgccaaaaaaataatcaactacaggattgagatgtaacggacaaaacacaaaactgaaggagattccagcgaaaacttggctctggcactgaaatagggtggacgaggttctgttcgttatgtctgtaacacggtgctggccatgtgctagctttgtaatctcaaaacattgtctttgcctcaataatgtaagttggtcatacgatgattccaaaatttactgcacacc

SEQ ID NO: 777 - DNA, 989 bp, Sorghum bicolor
ccgtcttccccatctcgcgctgcgctactgccgcggctgtcccgagtcccgaccaccgtcctccgctccccgcccttcctcttctcctcccgcgatggagacctgcccctcggtgaagaacatcctcttgctggactccgaggggaagcgcgtcgccgtgaagtactacagcgatgactggcctactctctccgcgaagctggccttcgagaagtcggtctttgccaaaacccagaaagcgaatgctggaacggaagctgagattgtaatgtttgatggtcaaattgtggtatacaagttcatccaagacctgcatttctttgttactggaggagaagaggagaatgagcttattttagcatcagttcttcagggattctctgatgctgtcgaacgacttctcaagttacttcccctctattaaagtttatcttttcaactgctgtttgttctgttacatgttattgtgttagtgctgattgtatatgaatgtgtttccaatcttggtggtttcagaaacatggttgacaaaaggacagcacttgagaatttggacctgatcctgttgtgtcttgatgaaattgttgatggagggattgtacttgaaacagaaggaagagagatagctgaaaaggtgtctggtcatggattggagggtgcttcatcagctgagcagactctagtgaatgccctaacgcaagcaagagaacatttcgcgaagtctcttctcatgtgatgctgtgctttatactttggggtgacgatggagtatcaattattgtgtctggacaacatattctttttgttagcaacggagaaagaaaaatgtctgaaatctatgaatgtgtagaatggcatggtgttcctgaaattctcatgttcatttgtaagctttcaaagttgtgtagcatgaatattctaattttgactggctcagttattggtcgttttgtttaacctgttcctgttggaaacggtaaaaataacat

SEQ ID NO: 778 - DNA, 3999 bp, Sorghum bicolor
ccattatttattactagtattattttattcaatctccatctggatgcgtgtgtgtgacttgtgagagagacagattccacagcaatttgctcctcttccacgcacagcccaaggcaagaactgctccccggaaaaagatcgtattttcagccggtttctgtccggcaaatcgctgccggagatcttagaaccggaaggctcgaagtttctgctccgtttgcgtcgaatctgcctcgggaagcggagaaaggagcggcctttcgagctcgtaggggccgtccctcagaaggctagaggggacgcggcggcggcggtggcggcggcggcagctctagggcgctcgtggaagtcggtgatgccggtttgaggtcaaggcggccccggtggttttgaggaagccgggcggggatggactccagcggggaggaactcctgaagaagatccgggagctggaggttgggcaggcgcagctcaagcaggagatgtccaagctaatacccggcgccggggagcggcgacgctcgcaatccgtctcgccgcggcgcggcgcgccggtgccgccgccaccaccggccaaggggaaggcgggggcgccaggtaggcggctgtccgggggttttgagggcgggcagcgtgcgtgggcccgtgggtcggcgtcgttcccgcactcatcgccgctgcagcgggagggccgcgccgcgggcgctggagacgctagcaccagcgctaggctgccggagaggcagtactctagggtgctgcagtcactggggcagtccgtccacattcttgacctcgacgggaggatcatatactggaatcagtctgcggagaatctgtttggctatcctgcatcagaagcccttggtcaggatgccctaatgcttctggttgattcccatgaccacaatgctgtaaatgacatcttccgacgtatttctatgggtgaaagttggactgggaagtttccagttaagaacaggcaaggagatagattttcagctcttgccaccaacacacctttctacgatgaggatggcagcttggtgggtatcatttgtgtttcaagtgattcccgcctcttggagcaaatattttgtaagcctccaacctctgcaaggccccagtcagaatcatctaggacatcttgtgacgggagttgcagcaacactagtcgcagaatcaatttgttgaacaaaagtccttttgatcctcagctacccctgcaaagcactttagcttccaagataacgaatttggctaccaaggtcacaaataaagttcgttctcgggtcaggacagatgagaatggcatagagcgggaaggtggcagtggtgagagtcattgctcggatcgtggtgcaaaggaagagccaacatctagtggaacaaatacaccaagaggggatgcaccacatggtccctttgctacagaagagaactcccctgggaaatcaatgaacccaaacagcgatgaatcagaaggaaaaatagctctgcacaagatttggagtacaaaagcagaggcactactgaacaagaaagggatatcatggccttggaaagggcgcgaaaatgagggacctgatgaaaggaatcatgtgatattgccgtggttgcatggtgaccaagagaatggtacgaatcatcagaaggtttctgattctagcatagttccagatgcccaaggcgctgaacacaaccaacctaacaaaaatgaggcatcaggttcctggtcctctttcaacaataacagcacaagcagtgcaagcagcacgggaagcactaatagcagtgctctctacaaagttgatcatgaagcggattgtctggattatgagatcctgtgggaagacctcgtcattggagaacaaataggtcaaggctcttgtgggacagtataccatgctttgtggtatggttcggatgtggctgttaaagttttctccaagcaagaatattcagaagaagtgatactgacctttcgacaagaggtatcccttatgaagaaactacgccatcctaacatactgctcttcatgggtgcggttacatctccacaacgcctttgtattgtaacagagtatctccctcggtatgtccctacttttttacaagcgtacatgtttgcaagtgtttgttattctgtggcatttcctcatgttgcacatctacttgagttgagccaaaaagtttgtttgcatctgattgaatggtttgattacaacaatagttgcataaggaaaaggaaaattaaattcagaaattctaggctttgtttaagttgagaagtcattgatatgcatacattttgctgttggaagtggtgtatcgtgcaaaatctatatttaagtaggattatgtagtaaaatgcctctctagaaatcgaagtattttgcccaaccttagggaatctggatgcatgtatagaaatataaaaccataatgtctaacctaggcgatactgtccctggttcaaatttcaaaatatatgctgtttatgattcctacagatcaaacttttttgacattgaccatggatatgtctaggattatgcagatttactatgtaagatgttgctagatttatcttgaaaattactttcataatgtttagttatgtttattggagatcatattttcatagaaaatgctagtccaagtgtcacttatagactgtgtgtgccccaactgtcttatacttcaaatcagagggagtattcttcatgggtgatgtatgacagccgatctatgagatccttttgcttgggttggtttggttgcatgttcaaaacactgtcaagcacccaaacaccttttttttggttcatttccctatttttgatcctgtcttttcaaatgcagtggaagcttgtttcgcttacttcaaaagagtgctaccaagttggatgtgagacgacgtgttcacatggctttagatattgcaaggggcatgaattatcttcaccattccagcccacctatcattcatcgagatttaaaatcatctaatctgttggttgacaggaactggactgtgaaggtggcagactttggtctttcacgtctcaagcgtgaaactttcttgacaacaaaaacgggaaaaggaacaccgcaatggatggcgccggaggtgttgcgcaatgaaccttccgatgagaagtctgatgtgtatagttatggggttatcctgtgggaacttgttactcagaagataccgtgggaaaatctgaactcgatgcaggtcattggtgcagtaggttttatgaaccaaaggttggatatcccagatgaagtagatcctcaatggaaatcaattatcctgagctgctgggaaagcgacccacagcaacggccgtcattccaagagcttctggagaggctccgagagctgcagaggcattacgccatccagcaccggaacacaaagaacagcatcgaggagtgacgaatgcaatgcaactcccagagcgcggtgggctttgctttgaagcattttgcgagtgaccaagctgagtgagcggcatgtgtcagatctcgagaagggcctgaacctcctgtactgtatggttttgcttcgccgaaacagctaaggctggaagaagtttgttgtacagacgagggtaccttctgtcttctttggtttttcctttcctccccagggcaattgtgactgtaatttctgggtgctgacagcaaaggtagtagggtagcgagtgagtagtgactgagctccggattgctggcgcctttgggttcttctgattcgtggcaatgcaaatgcgtggttaacaataacatccaatccgggcttgagttttctggcaagggcatgatgatctgtaggttgtttgttctgagtttctgacaacagtggtgtattgtatacatgtgatcgattgtgatcatgcgtgagtttaatcgatgtactcgtgaaatcgactcttttttgcttcattcacataatcggtcgtcagacttgccgtcaggattttttt

SEQ ID NO: 779 - DNA, 1220 bp, Sorghum bicolor
gcgacgcaagtcacgcagacgctgcacgctgtcgtctcgcccgtcttccccccgaaggccgccccgacctcaccgcgtcttctcctactcggcttgacccctccaccacctccatggggtcgtcggaggccgacgaggaccagctcctcaagagcttcctcgcggaggtcagcgaggccgagcgggacaacgaagtgctcaggatacttggttgcttcaagttaaaccccttcgagcatcttaagttgtcttttgattcatcaccagatgaggtgaaaaagcaatacaggaagttatcattgttggtccatcctgataaatgcaagcatcctcaggcacaagaagcttttgcagctctggcaaaagcacaacagctcctgcttgatccacaggaaagaggctacattcttgaccaagttactgctgcaaaagaagaattgagggcaaagcggaaaaaggagctgaagaaagatagtgcgtccaagataaaatctcttgtagatgagggaaaatatgaagagcagtttgaacgatcggacgaatttcagcagcagttaataattaaagtacgtgaaattttgacggacaaagaatggcgtcggagaaaaatgcaaatgaggatatctgaggaagaaggaagacttaagaaggacgaggaggaaacaaaagagatgtggaagaggaagagagagcatgaagagaagtgggaggagaccagagaccagcgggtctccagctggagggatttcatgaagacaggaaagaagggacggaaaggtgaaatcaaacccccaaaattaaagactgaagatccaaacaaatcttatgtccaaaggccagtaaagcgcaattgagaggaatgatattagtgtcagcaatcaaagaacatctggtagcgatctttggtgtcaccagattcaaactgcaacccttccatgttgcgctggccctcaaggttgtgaggttcaattatgcccgctgggctgatgagctctagtgtcgtcagtgaacagaacagattttacccgtattgctacctagagtgatttgggtgatgtactcatcagtctgaagattttactggaaagaagtacaaattttccgttggaaaagaacctactgaagtgaatgttgacaggctcgtctctttactgttttgtatcattttaatgtaagtaatgctgatatatatacatggtttgtcatcattgatgcacttt

SEQ ID NO: 780 - DNA, 1012 bp, Sorghum bicolor
ggaaaaacgccgcgacgagccgacgagctctacttcccccttccggccttgggcgaccgtgacgagcgacgacgaccacggcgacgatggccgcttcctccctctgccacgggcacctgctcctgttcctcctcgtggccgtcgcgtcggcctgcctcggcaccgcggcagcgcatcaagccggatctggagaggggtacacgatcgccggccgcgtcaagatcgatggtgcgagtgcgaagggctttggtcttccagccaagacatcaaacacaaaagtgatacttaatggcggccagagggttacatttgccaggccggatggttactttgcattccacaacgtgccagctggaactcatctgattgaggtctcctcaattggttacttcttttccccagttcgagtagatatcagtgcaaggaatcctggttatattcaagcagcattgactgaaaccagaagagttctaaatgagcttgttcttgaacctctaaaagaagagcagtactatgaggttagggagcctttctctgtcatgtcacttttgaagagtcccatggggttgatggttggttttatggtcttaatggtcttcgtgatgcccaagttgatggagaacatagatcccgaggagatgaagcaagctcaagaacaaatgaggaacaaccccgtatcattctctggcttgctatccagagcgcagggctagaagtagagcatgaggatactgcaaaggtctatatactctataatgtgattaagagcagtactaaagtgcctgacacgtcattcactcagagtaatttcctggggacaaggcggaaactctttcccctgcttttactgtattttaagctgtaatttgtctgtgatgtagaaccttctgaaacctctagctgaactggtcatgtggcacattagcatataccgcagattgagacattttgtccaatatgtgtattgtttgtttgaatcagttgaatcttagacaccttgcttagtcatcag

SEQ ID NO: 781 - DNA, 1687 bp, Sorghum bicolor
accgagagtggtaggaaagctcgtcgccgtacggggctcggctcaggtgagagcgagcgtcgggtactgaggccggaggcgatgccgatgggccgcctccgcgacgggcgagccttcctccaccgcgcgctggtcctctcgtcgctgctgctcctcgcctcgggcgaaatcttcttcgaggagcggttcgatgatggttgggatagccgttgggtgaaatctgattggaagaagagccaaggacaaaccggaaccttcagacacacagcaggaacctattctggagatcctgacgataaaggtatacaaacaactggggatgccaaacattttgctatatcggcaaaattcccagaatttagtaacaaggaccggacattggtgatccagtactctctaaagattgagcaagacattgaatgtggtggtgcttacatcaaacttatgtctggttatctcaaccagaagaagtttggcggcgacactccttacagcttcatgtttgggcctgatatatgtggggatcagaaaaagaagcttcatctcatactttcataccaagggcaaaactaccctatcaagaaagatctaaaatgcgaagcagacaagttgacacatttttacacatttattctaagacctgatgccacttatagcatccttattgataaccgggagagagaatttggaagcatgtacactgactgggatatccttcctcctcgtaagatcaaagatgttaatgcgaaaaagccaaaagactgggatgacagggaatatattgaagatcctgatcaagttaagccagagggatatgattcaattcctaaacagatacctaatccaaaggacaaaaagcctgagtcatgggatgatgacgaagacggtacatggaagcccagaatgatacctaatccagaatacaagggaccatggaagcggaagaaaattaagaatcctaactacaaaggaaaatggaagaccccgtggattgacaatccagagtttgaggatgacccagacctatatgttttgaaacctttgcagtatgtggggattgaagtctggcaggtcaaagctggttcggtttttgacaacattttgatttgcgatgatccagactatgcaagacatgttgtagatgaaacttttgctgcaaataaggaggctgaaaaagaggcctttgaaggagctgaaaggaagaggaaggctagagaagaagaggaagcacggcgagcacgggaggaaggggagagacgaaggcgggagagggatagggaccgtggcagggaccgttacagggatagatataagcgccatagacactacgactaccatgacgagctatagatcatgtgttttgaaatctgcacgttattggttgtctatggaagcacacgtgcagaacttgtatgttgtacacacgaatcaagctgaatttgtgatttttggcgatgggtagagattgaccatcgcggctgtaactaaatttccccattgcgaggcaatatgagctgtagtatccttgcactatcatttacctcgaaatgttatattcgtgctgcatacgttgataaacctttcattgtcaggagtcgggacaaggaaaaacacgaaatggccctagtcactcaactttttacgacttaaaatgactagtgtgcccgaatcagaatccttttatatt

SEQ ID NO: 782 - DNA, 1482 bp, Sorghum bicolor
ccgcgctcggccacttcagcttctatttctatccctccacaccctcttatctgcttcccctcccctcccctcccccacctccaccatggccacagcagctgcggccaccgccgcctccacctccctgctcgcgccggcggcgagcagcacggcgccgggggcctcgcccaacgcgctgttcttcccctcctccgtgccgtcgctgcgcgcctacccgcggctcctcctcgcgttccgccgccccgccgccgcggccgcccagggcgccgtgctcgaagaggaggaggtacaggccgaccagcggggccagtacgacgacgacgacgacgggtacgagggcgggcgcggccccgcgttcacggcccccacgcggccgcgcaccggcaaggccgcactaccgctcaagcgcgaccgcacgaggtccaagaggttcctcgagatacagaagctgagggagagcaagaaggactacgacgtgcccaccgccatctcgctgatgaagcagatgtccagcgccaagtttgtcgagtcggcggaggcgcacttccgcatgaacctcgaccccaagtacaatgaccagcagctccgggccacggtgaatttgcccaagggaacaggccagtcggtgaagattgcggttctcacacaaggtgagaagatagatgaagctagagctgcaggagcagatatcgtaggtggagaagatttgattgaacaaataaaaggaggatttatggagtttgacaaattgattgcatcacctgatatgatgcctaaggttgccggcttgggtaagattctaggaccaagagggctgatgcctaaccccaaagctggcactgtttctccaaacattactcaggctatcgaagagttcaagaaagggaaggttgaatacagagttgataaatcaggaattgtccatattccctttggcaaggttgactttccggaggaagatctcattgcaaacttcatggccgttgttcgctctgttgagaggaacaagccatctggtgctaaggggatatactggaaaacagcgtacttgtgctcatccatgggaccttctatcaagctaaacataaaagaaatgcttgattatggtttggactcatctgactagatgtgaccacaggcaccagttaagtcagattaactatctgccccttgcgacaaatgagcggagacatggttgtggggtatggcaaggaggtgcttaggtacagttttttcagttttacgggcacccatcatcagagcagctaaagtatgcccagatcgacaaagaggtggtcttgttggtcatgtatttatgagcaaattattcatggtttcatagatgtctgtctctgagacgtttgttgtaatgtttcatattctgtcaatagtcatccttgagcttaagccagcaatttattttcacctgtcattaacataagtacttaccgttcatgtttgtgttggcgagtcggcatgtat

SEQ ID NO: 783 - DNA, 870 bp, Sorghum bicolor
aagcgctatgggatctgcgaatggtggtggcctcgattttgtttaaagggttgaaggaattccaagggttgaacctttgtttgatgcaggagacctgcccctcggtgaagaacatcctcttgctggactccgaggggaagcgcgtcgccgtgaagtactacagcgatgactggcctactctctccgcgaagctggccttcgagaagtcggtctttgccaaaacccagaaagcgaatgctggaacggaagctgagattgtaatgtttgatggtcaaattgtggtatacaagttcatccaagacctgcatttctttgttactggaggagaagaggagaatgagcttattttagcatcagttcttcagggattctctgatgctgtcgaacgacttctcaaaaacatggttgacaaaaggacagcacttgagaatttggacctgatcctgttgtgtcttgatgaaattgttgatggagggattgtacttgaaacagaaggaagagagatagctgaaaaggtgtctggtcatggattggagggtgcttcatcagctgagcagactctagtgaatgccctaacgcaagcaagagaacatttcgcgaagtctcttctcatgtgatgctgtgctttatactttggggtgacgatggagtatcaattattgtgtctggacaacatattctttttgttagcaacggagaaagaaaaatgtctgaaatctatgaatgtgtagaatggcatggtgttcctgaaattctcatgttcatttgtaagctttcaaagttgtgtagcatgaatattctaattttgactggctcagttattggtcgttttgtttaacctgttcctgttggaaacggtaaaaataacat

SEQ ID NO: 784 - DNA, 2086 bp, Sorghum bicolor
acccggggtctgggtcgcgtcgcgtctcatcattttcccctcgtgcgctctctcgaaccttccaaagcccccgaaccctagtgagctcggaaccctagccgcgcgcggatctcggcttgcttgccccctcctccacgccagccatggatgacgacttcgagatgccgaccgccggcgccgacgagatgatgggcgacgacgagatgggcgacttcggcggcgatgagggcccggtgttgaaggtgggcgaggagaaggaggtcggcaagcaggggctcaagaagaagctgctcaaggagggcgagggctgggagacgcccgaggtcggcgacgaggttgaagtgcattacacgggtacactccttgatggaacaaagtttgactcaagccgtgatcgcggagatcctttcaagttcaagcttggacaaggtcaagtgataaagggttgggatcaaggcatcaagaccatgaagaaaggagaaaatgctgtttttaccattcctccagaactggcttatggagcatctggttcaccgccaactattccaccaaatgcaaccctgcagtttgatgttgagctgctttcatggaccagtgtcaaagatatttgcaaagatggcggcatattcaagaagattcttaaagagggggagaagtgggagaacccaaaggatcctgatgaagtacttgtgaaatatgaggcccgtctcgaagatggtactgttgtatccaagtctgagggggttgagttcactgtaaaagatgggtacttttgtcctgccctggccaaagctgtcaagaccatgaaaaaggcagagaaggtgctccttacagtaaagccacaatatggatttggcgagaaaggtagaccagcagctggagaggaaggtggtgtgccaccaaatgccactctgcacattgaccttgagttggtttcgtggaagactgtcacagaaattggtgatgataagaaaatccttaagaaggttctcaaggagggagaaggttatgagcgtcccaacgagggtgccgttgttgaagtcaaaattaccggaaagcttcaggatggcacagtgtttacaaagaaggggcatgacgaagagccatttaaattcaagaccgatgaagaggaagttatagatggtcttgatcgtgctgtattgaacatgaagaagggtgaggttgctcttgtcacgattcctcctgaatatgcatttggttcaactgagtcaaagcaggatcttgctgttgttccacctaacagcacagtggtctacgaagttgaacttgtttcatttgtgaaggacaaggagtcgtgggacttaaacaatgaagagaagattgaggctgctggtaagaagaaagaggaagggaatgcattgttcaaattgggcaaatatgctagagcttccaagcgatatgagaaggccgccaagtacattgagtatgaaagttcattcagtgaagatgagaagaagcaatccaagcaactgaagatcagctgcaacttaaacaatgctgcctgcaaactgaagttgaaggactacaaggaagctgcgaagctttgcaccaaggttctggagctagatagccaaaatgtcaaggctctctacaggagggtgcaagcgtacattcaacttgctgacctagagctagcagaggccgatatcaagaaggcactggaaatcgatcctaacaacagggatgtgaagttggaatacaagaccctgaaggagaagatcaaggagtacaacaagaaggacgcgaaattctacagcaacatgttcgctaagatgacaaagtaactggcactggccaaagacagtatggcttcttgggtagaggatgtagtgaagcaaaggattacaagcaatgccattttctgctgcccaaggacttcgcctgttgcttaacattcaacctttggcatactttgtagtcaattagcgcgcatggatgcttggatatgtgaaactgaggaacaattacttcgaggattattattggctctgaatctttctgtttttttggttcttgttaggaccattgattctgtcgtttaagaatcttatgcatttcacacaca

SEQ ID NO: 785 - DNA, 2313 bp, Sorghum bicolor
gcttccttcgccacctctcgcgtctcccctctcccgaaaccaaacccctcgcactccaactcctcaatctgagcagtgtagaactctctcgccctactccgaccgtcaaaaaaatccaatctttccgctcccctccgacgttctcggaggccgcacggctgcaagattgatcaatcctgcgcggatcgagccgcagacaccaccactgggtgcttgcggaccgcagagcagagcccggacggagcatggggtcccgatccgccgccagcgcggcgctgcggatatggctgctggtgtccgtggcgctgctgctgggctgctgccagggaaggttcgtggtggagaagaacagcctcaaggtgacggcgcccgacgacctcaagggcacctacgagtgcgccattggcaacttcggggtgccccagtacggcggcaccatggtcggcttcgtcgcctaccccaaggccaacaggaaggcctgcaagagcttcgacgacttcgacatctcctacaaggccaagccgggggcgttccccaccttcttgctcgtcgacaggggagattgctactttgcaaagaaggcatggaatgcacagaaagcaggagcagcggcgatccttgttgctgatgacaaagacgagcctctaattacgatggacaaccctgaggagagtggcaacacggattacttagagaacatcactattccttcggcgttaataaccaagagctttggggacaggctcaagaaagcaattgacaaaggtgacatggttaatgtgaatttggattggagggaggccctgccccatcctgatgagcgtgttgagtatgagttttggaccaacagcaatgatgaatgtggcccaaagtgcgatagccagattgattttgtcaagagcttcaaaggagcagcacaggtgcttgagaagaagggctacacagagttcactcctcactacatcacctggtattgcccagaggccttcattctgagcaagcagtgcaagtcccagtgcatcaaccatgggagatactgtgcacctgacccggaacaggattttagcaaaggatatgatggaaaagatgtggtggtccagaacttgcgccaagtttgtgtctttaaggttgctaaggagcacaagaagccttggttatggtgggactatgttactgattttgcgattcggtgcccaatgaaggaaaagaagtacacaaaggagtgtgctgaaggggttattaagtcgcttggccttgatcataaagcaatagataagtgtattggtgatccagatgctgatgaagaaaaccctgttctgaaagctgaacaagatgcacagattggcaagggctctcgtggtgatgttaccatcttaccaactctggtaatcaacaatagacaatacagagggaagcttgacaaaggagcagttcttaaagcactttgtgctggttttaaggaaaccactgagccagccgtttgcttgagtgaagatatacaaacaaatgagtgcctagagaacaatggtggctgttggcaagataaggctgctaacatcactgcatgcaaggatactttccgtggaagagtttgtgagtgtccagttgtgaaaggagtaaaatttgttggtgatggctatactcattgtgaagcttccggatctgggcgatgtgaaattaataatggaggatgctggaaagataccaagaatggtcggacatactcagcctgtactgatgatggctgcaaatgcccagatggattcaagggtgatggtaagcacaaatgtgaagatattgatgaatgtaaggaaaagactgcatgtcagtgcaaagaatgcaaatgcaaaaacacatggggaagctatgagtgtggctgcagtggaggcttgctttacatgagggagcatgatacatgcataagcaaaaatggaggatcagaagcaggctggggcttcttgtgggtcgtcttcttcggccttgttgcagcaggaattgcaggatatgcagtgtacaagtacaggatccggagatacatggactcagagatccgtgccatcatggctcagtacatgcccctggacaaccaaggagatgtccagagccattctcaccatattgagatgtgaggtggatgcagacttgatgagaggagaccgacacttgatctagcttatatacacttgaattagatgtgcataaccgtaactttcttctgtagcattcagtgtccttgaacaatttgtatctgtgtggtttctgtgttaggttgtaccatgacatggtcttgtttagtaataattgtcatctttt

SEQ ID NO: 786 - DNA, 2532 bp, Sorghum bicolor
gagacggaggagagaccaggccccgcatcccccgcgcgcgccgcacccgttccgcgtgcgtgcgcgcctatataaaccgccgacgggacggggcgccggcgtaggaagccgcggccagagcccagagagccccagagccagttcccgttcccgtccatcaaccgtcaaaccaccaccaccacccgcgcccaccactccactccgtccgctctcgcctgctctgcttgctttctctcgcacgctccagcggatggcggaggcggaggcggaggccgcgcccgcagcagcagccggcggcggcggcatcggggacatcctcgccaccgccgagcgggacttcctcgtccgcaactccggtgagcaggtgaagatcagcagcatcgaggcgagccctgtggccatctacttctcggcctcatggtgcccgccatgcaggaggttcacgcccaagcttattgaagtgtacaaagaactggctgaacagggcaagagcttcgaggtcatctttgcttcggctgatcagaatgaggaaggattcaatgaatactttgcaaagatgccatggttggctgtccctttttctgacaccgaaggccgtgcggcccttgatgcccggttcaaggtctctggtatcccacacctggtcatccttgatgcaaaaactggtgaagtttacactgaagatggtgttgaatttgtgagtgagtatggcgtggaggcttaccctttcacaccagataggatcaatgaactgaaggaacaggaaaaggcagaaaaggagaatcaaactattcaaagcgtgcttggcacatctactcgagactatctcatttcaaacaagggagacaaggtacccatctctgagcttgaggggaagtatgttggtctgtgctttgtggtggatggctatggaccagtcattgaattcactgattcgcttgctaagatctatgagaaactcaaagaagtgggggagaaatttgaagttgtagctgtatccttggacagtgaagagtcagcatttaatgagagttttgcaaagatgccttggcttgcaattcctcaaggtgaccagaagtgtgagaagctggttcgttactttgagcttaggtctcttcctacactagttctgattggccctgatgggaagacactgaacagcaatgttgcggacataattgatgagcatggttttgaggcatgggagggcttcccattcagtgctgagaagctggaaattcttgctgagaaggcaaaggctaaagctgcatctcagaccttggagtcccttctaatcagtggtgatttggactttgtcattggaaaaggtggagcaaaggttcctgtatcagaacttgttgggaagactgtcctcctctacttctcagcaaaatggtgtggaccatgccgtgccttcctgcccacacttgtcaaggaatacaacaagatcaaagagaagaacagtgattttgagatcgtcttcatctccagtgacagggatcagagctcattcgatgattttttctctcaaatgccatggcttgctctacccttggaagatgaaaggaaggtatccctgaagaagaccttcaaaatccgcgggatcccttcacttgtcgccatcggtcctactgggcagacagtcagcagggacgcaaaggcccagctgatgatccacggtgctgatgctttcccattcactgaggagagactcgaggagctgcagaagaagctggacgagatggcaaaggggtggcctcagaagctgaagcatgagctgcatgacgagcatgaactcgtcctgctgcgccgtggtacgtacggctgcgacgggtgtgaagagatgggcagcacatggtcctacaggtgcgatgagtgtgactttgatctgcaccccaagtgcgcgttggcggaggaaaagaaggtgaggaagcccctgctgggtatgtgtgcgaggaaggcgtgtgcaggaaggtctagatttgttctactgagttgcctttgcgtttccggtgctatctgaatggtgtgagggatgacaataatcgtgagatggttgtgcttggagccgaggtttttgagctgctgatgtttgtgtgttaataaatagtagttgtaccctgaactcttaagagcgtatgtgtatgcagaactatgtgagtattagatcaaagtaatggttttgctacatggtatttctgcttttaaaaatgtgatgttggtggcaatttttatttttcccttgcatttctgcaatcttgcatgctagacattgttttggttttggatccacatgattgtctttgttccgaagcatggtcaaggatgaggtgagtagtttggtggtgttagtattccaaatcgcattgtttgacttgttctgtgaaggtcttctgcatccttgccaggttcagattatagatccacatctggtgatatgcatgcatggtcggttgtttgtcgaagctgtcagccattgtgtgaatgtaaaaatttgggggaacaacttgaaacgcggttttgtttggttct

SEQ ID NO: 787 - DNA, 1058 bp, Sorghum bicolor
ctctcctcgctgtttcggagccccggggccggggggaaggccaacccgaccgtcccaccgcgtcgtctccctcctcgtctcctctcctctcctctcgcgtccgcagcttcccttgcaggctagggtttgcagatgacgacgggggcacccgcatcttcggcccctcccagaagtactcctcccgcgacctcgccgcgcacacctccctcaagcccagaaaagatggtcaacagacccaagaggagttacagaagaggaacctcagggaggaacttgaggaacgcgagcgcaagcactactcttccaaggataagtcctattctgaagaaagagaccggcggaaaagctcaagccagctactcttagaaggttcaaagagagaggcagaggataagatagttccacgagaaatcgatgcagatgactctgatgtggagcctaaaagtgatgatgagagtgatgaagatgatgacgacgacgacgacactgaagctctaatggcagagcttgagaggattaagaaagaaagagctgaggagaagcttagaaaggagcggcaacaagcagaagaggaggccaagatgaaggaggctgaactgatgcggggaaaccctttgattaatatcaacaatcctggctccttcagtgttaagagaaggtgggacgatgatgtggttttcaagaaccaagcacgtggagagaccaagacaccgaaacggttcatcaatgataccatcaggagtgatttccaccgtaaatttcttcagaggtacatgaagtgatggtaccgctgtgtacaacttacatgtctccgctccttgtatgggagagcattggttcagttgggagctcttatcgttgttatgtttgtgtacgagtgaaagaccagcatagcattggttcagttgagagctctcatcgtgttaagtttgtgtacgagtgaaaggccattattgtgttgctgtatgaaacaaaagtataaacatctgtcggcatcttaacaaagctgtactgagcaatacatatcttatctgaatgtgccaaggtcctatttttct

SEQ ID NO: 788 - DNA, 878 bp, Sorghum bicolor
ccgtcttccccatctcgcgctgcgctactgccgcggctgtcccgagtcccgaccaccgtcctccgctccccgcccttcctcttctcctcccgcgatggagacctgcccctcggtgaagaacatcctcttgctggactccgaggggaagcgcgtcgccgtgaagtactacagcgatgactggcctactctctccgcgaagctggccttcgagaagtcggtctttgccaaaacccagaaagcgaatgctggaacggaagctgagattgtaatgtttgatggtcaaattgtggtatacaagttcatccaagacctgcatttctttgttactggaggagaagaggagaatgagcttattttagcatcagttcttcagggattctctgatgctgtcgaacgacttctcaaaaacatggttgacaaaaggacagcacttgagaatttggacctgatcctgttgtgtcttgatgaaattgttgatggagggattgtacttgaaacagaaggaagagagatagctgaaaaggtgtctggtcatggattggagggtgcttcatcagctgagcagactctagtgaatgccctaacgcaagcaagagaacatttcgcgaagtctcttctcatgtgatgctgtgctttatactttggggtgacgatggagtatcaattattgtgtctggacaacatattctttttgttagcaacggagaaagaaaaatgtctgaaatctatgaatgtgtagaatggcatggtgttcctgaaattctcatgttcatttgtaagctttcaaagttgtgtagcatgaatattctaattttgactggctcagttattggtcgttttgtttaacctgttcctgttggaaacggtaaaaataacat

SEQ ID NO: 789 - DNA, 1873 bp, Sorghum bicolor
gtacaaaacttaaacagaagaaggcgaggcggaatcgcagtcgctcaaggtcacggcctcacaggtgactcacgaatcgagctacaggagagggaagcttcaggaaacgaagccgagaggagcgaaccttctggttcgtctgcgctgcgtatcaagatcacagggttgtgcttgaatcgcgggcgttgggaacccatccatggcgaggaagatgcttgtcgacggggaggtggcggccgtcgcggacgccgggcagtacgactacgatctgttcgtcatcggggcgggcagcggcggcgttcgcggctctcgcttcgccgcctccttcggagctaaggttgcgatttgtgagctcccattccaccccatcagctcagagtggctaggaggacatggtgggacgtgtgtgatacgtggttgcgtacccaaaaagatactcgtgtacggtgcatctttcggtggagagtttgaggattcaaagaatttcgggtgggagattaatggggatattaacttcaattggaaaaagctgttggaaaataagactaaagaaattgttagattaaatggagtatatcagaggatccttaccaatgctggtgtgacaatgattgaaggggcaggcagtctagttgatgctcatactgttgaagttagccagcccgatggttcaaagcaaaggtatacagcgaagcacattttgattgcgactggtagccatgctcaacgtgtcaacatacctggaaaggagctggctattacatcagatgaggccttgagcttggaggagcttccaaagcgtgctgtaatcctcggtggcggatatattgctgttgaatttgcttctatctggagagggatgggtgctgaagtagatttgttttatcgaagggagcttcctctaagaggttttgatgatgagatgagaactgttgttgcaagcaaccttgagggaaggggaatcaaattgcatccagggacaaatctgtctgagttaagtaaaacggctgatggcataaaagttgtaactgataaaggagaagagctcattgcagatgttgttctatttgcgacagggcgcacaccaaactcccagagattgaacttgcaagctgcaggcgtcgaggttgaccagattggtgccatcaaggttgacgaatattctcgtacatctgctcctagtgtatgggctgtgggtgatgtaacaaaccggatcaatctaacacctgttgcattgatggaggcaacttgctttgccaaaactgtgtttggtggccaggaagttaagcctgactatggagatgttccttgtgctgttttctccattccaccactatccgtagtgggcctcagcgaacaacaggccttggaggaagccaatggtgatattcttgttttcacttcatcattcaacccaatgaagaacagcatatccaagcgccaggagaagactgtcatgaaactggtagttgatgctgaaactgatagagtacttggtgcatccatgtgtggaccagatgcacctgaaattatccagggcattgctattgcgcttaaatgtggagccaccaaagcgaacttcgacagcactgtcggaatccacccttctgctgctgaagagttcgtgaccatgcggactgtgacaaggcgcgtgagcccgacatccaagccaaagacaaacttgtaagcaagagttgatgttctggggaatgttacacaacacaaatattctggtttcattttggtaattctacgtcattcaaactggaacactgtatattgaaggaatagggtttttgcatgacagtccacacaaaataatgaaagctcaagctgaggcctgaggatgttcatggttgcattggttctctgc

SEQ ID NO: 790 - DNA, 861 bp, Sorghum bicolor
ccgtcttccccatctcgcgctgcgctactgccgcggctgtcccgagtcccgaccaccgtcctccgctccccgcccttcctcttctcctcccgcgatggagacctgcccctcggtgaagaacatcctcttgctggactccgaggggaagcgcgtcgccgtgaagtactacagcgatgactggcctactctctccgcgaagctggccttcgagaagtcggtctttgccaaaacccagaaagcgaatgctggaacggaagctgagattgtaatgtttgatggtcaaattgtggtatacaagttcatccaagacctgcatttctttgttactggaggagaagaggagaatgagcttattttagcatcagttcttcagggattctctgatgctgtcgaacgacttctcaaaaacatggttgacaaaaggacagcacttgagaatttggacctgatcctgttgtgtcttgatgaaattgttgatggaggaaggaagagagatagctgaaaaggtgtctggtcatggattggagggtgcttcatcagctgagcagactctagtgaatgccctaacgcaagcaagagaacatttcgcgaagtctcttctcatgtgatgctgtgctttatactttggggtgacgatggagtatcaattattgtgtctggacaacatattctttttgttagcaacggagaaagaaaaatgtctgaaatctatgaatgtgtagaatggcatggtgttcctgaaattctcatgttcatttgtaagctttcaaagttgtgtagcatgaatattctaattttgactggctcagttattggtcgttttgtttaacctgttcctgttggaaacggtaaaaataacat

SEQ ID NO: 791 - DNA, 2494 bp, Sorghum bicolor
gagacggaggagagaccaggccccgcatcccccgcgcgcgccgcacccgttccgcgtgcgtgcgcgcctatataaaccgccgacgggacggggcgccggcgtaggaagccgcggccagagcccagagagccccagagccagttcccgttcccgtccatcaaccgtcaaaccaccaccaccacccgcgcccaccactccactccgtccgctctcgcctgctctgcttgctttctctcgcacgctccagcggatggcggaggcggaggcggaggccgcgcccgcagcagcagccggcggcggcggcatcggggacatcctcgccaccgccgagcgggacttcctcgtccgcaactccggtgagcaggtgaagatcagcagcatcgaggcgagccctgtggccatctacttctcggcctcatggtgcccgccatgcaggaggttcacgcccaagcttattgaagtgtacaaagaactggctgaacagggcaagagcttcgaggtcatctttgcttcggctgatcagaatgaggaaggattcaatgaatactttgcaaagatgccatggttggctgtccctttttctgacaccgaaggccgtgcggcccttgatgcccggttcaaggtctctggtatcccacacctggtcatccttgatgcaaaaactggtgaagtttacactgaagatggtgttgaatttgtgagtgagtatggcgtggaggcttaccctttcacaccagataggatcaatgaactgaaggaacaggaaaaggcagaaaaggagaatcaaactattcaaagcgtgcttggcacatctactcgagactatctcatttcaaacaagggagacaaggtacccatctctgagcttgaggggaagtatgttggtctgtgctttgtggtggatggctatggaccagtcattgaattcactgattcgcttgctaagatctatgagaaactcaaagaagtgggggagaaatttgaagttgtagctgtatccttggacagtgaagagtcagcatttaatgagagttttgcaaagatgccttggcttgcaattcctcaaggtgaccagaagtgtgagaagctggttcgttactttgagcttaggtctcttcctacactagttctgattggccctgatgggaagacactgaacagcaatgttgcggacataattgatgagcatggttttgaggcatgggagggcttcccattcagtgctgagaagctggaaattcttgctgagaaggcaaaggctaaagctgcatctcagaccttggagtcccttctaatcagtggtgatttggactttgtcattggaaaaggtggagcaaaggttcctgtatcagaacttgttgggaagactgtcctcctctacttctcagcaaaatggtgtggaccatgccgtgccttcctgcccacacttgtcaaggaatacaacaagatcaaagagaagaacagtgattttgagatcgtcttcatctccagtgacagggatcagagctcattcgatgattttttctctcaaatgccatggcttgctctacccttggaagatgaaaggaaggtatccctgaagaagaccttcaaaatccgcgggatcccttcacttgtcgccatcggtcctactgggcagacagtcagcagggacgcaaaggcccagctgatgatccacggtgctgatgctttcccattcactgaggagagactcgaggagctgcagaagaagctggacgagatggcaaaggggtggcctcagaagctgaagcatgagctgcatgacgagcatgaactcgtcctgctgcgccgtggtacgtacggctgcgacgggtgtgaagagatgggcagcacatggtcctacaggtgcgatgagtgtgactttgatctgcaccccaagtgcgcgttggcggaggaaaagaaggtgaggaagcccctgctgggtatgtgtgcgaggaaggcgtgtgcaggaaggtgctatctgaatggtgtgagggatgacaataatcgtgagatggttgtgcttggagccgaggtttttgagctgctgatgtttgtgtgttaataaatagtagttgtaccctgaactcttaagagcgtatgtgtatgcagaactatgtgagtattagatcaaagtaatggttttgctacatggtatttctgcttttaaaaatgtgatgttggtggcaatttttatttttcccttgcatttctgcaatcttgcatgctagacattgttttggttttggatccacatgattgtctttgttccgaagcatggtcaaggatgaggtgagtagtttggtggtgttagtattccaaatcgcattgtttgacttgttctgtgaaggtcttctgcatccttgccaggttcagattatagatccacatctggtgatatgcatgcatggtcggttgtttgtcgaagctgtcagccattgtgtgaatgtaaaaatttgggggaacaacttgaaacgcggttttgtttggttct

SEQ ID NO: 792 - DNA, 2262 bp, Sorghum bicolor
ctctctctcctattcactcctcccagctccagctagcagcagctgctcgcttaaagagggaggaggagaggggcgaggagcaatgtcggagcagcagccattaccgcagcctcggagcagcatgcgggaggcgctggagaaggaggacaaggagaaggccgcggccgccgcggccaaggagaaggcggccgtacccaagaacggcggcaacggtgggggtggcaagaatggcggcgggggtaacggcggcggcgtgggtggcggcaacggcggaggcgccccgccgtccggggaggagacggcccgggagattcaggtggtgagggaggcgtaccggcgcgagacggccgcgccggcgtacgtcatccccgaggagccgccggccatggtggagctcgtgggctggtacatctacggcttctgctcctacttcatcacccacctgctgctgccggtgctcttccctgccatcatcacgcaggtcgccttccccaactccgacttcacgccggaccccaagtacaccctcaagggcgtcacctgctccgtccatgagatgtccatgtaccaaaggcttaccaagcactctattgtgattgatgattcccggatgtcaccactgggctggagtggtctatcatgggcaattggcattctcatcgtggcgccgctcctcactcagactgctcaccatcttgaccgtggccaatatcagtcactgatcctcattgctgccacgtcttttgggtcgttcttctgcctgctcacaggcttcttcaagacagtctgggtgttcctgttctacatcctcttcattgcgggctcaatcattattgcggaggcagtgcatacccgcaaccttggactgatgatccgtgggcttgctgcgcatgactcaggcaagcaccttgttcttcgccgccgtgctgctgcgagccagctcagcctgtactgcactgccattggaggcattggagcagccctcatggctgcattcatgtaccacatgctgcggcgcactgatcagctcactggcctctgggttgtgtccatcttctgtggccttatctggttcattggcatttgccatggtctcttcacaaacaggcccagcagctcatcacccaccactgcatttgagcccaacttcttcaccaagctcagctatagtatgacccttctgcgctacccacaggccattggcagcttggttgctgtgttcctgtcctcttttgccacaatgtgcatcttcaccagtggcacactctatgctatcggtggtgtttgcatcaagccagtgcttgtgcttgtgctatggatcctttacttcctgtttcccttgatctcacttccacttctccacccaatccagataataatccgtgctgacgctgttcgcatgcagctgcttggtttcataatctgcctatttgtatctggtgctgggttctacttcaagagccacaggtggagagctgcccacatcattgttatcgcccttgtccagagcactgccaatggcatattgtacgcatttggccgcattctgctccttgatgcctcaccaccagggaaggagggtgcattctcggtctggtatgcatttgtccgtgttactggtgccatgattggcttcgctgcttcttctgctggccctgggcgtgccggaggatcatttgctgctgcattccttgggagcttcctgggcatcattgtgctgatcttcggcaatgtcagcaacattggagcgctgaaggctgctgggcacctcaagggaatggacgatgagaagaggatgggcggacttggggagaaaggtgaaggcatgggtagcgccgtcgctgattcgggtgaaagcagggggagggtatgatgacaattcgtgaaggtgtatttctgggaggggaaaaaagattgcattctgtggaggttgtgtttgtgagaaggatttgttctctttttttttcttgtttcttcatgtttcagtgacactgttaatctcagtgctttgcccgtttgatgcatgatgatggatgacatagtggtagagtgtgctagttgttaatgtgttattcttttgcttgcaagacaattgtaactgatgatcatatggttcttcttcacccgcccaaattctctagcagtcaagcttcattcataattcaatttctgtcgaaaatgtgattgtggcattgtgtagagaaataaacctctgtaaactctgttgtagcgaccatcattccttcaaaagtcaggtgttca

SEQ ID NO: 793 - DNA, 633 bp, Sorghum bicolor
aggggagcacagagcgggcaggcgacagcatgtgcacgcgtccgcggtaggcggtagaactgtagcaggacggatggctggctgacgtgtgggcccggggtggcaggtggtgatctgggttggctgaccactagttaggcccagcccaactccgatgttcgatcgcatcagcgccccccaaagcagcctcctggtgtagctagggttttcgtctccgcggcttgctctaatcctctccaggcacgcgaggtaggggcgcagcgttgatggcggcggcaccggcaccggcggacgcgaaggcggaggccgccaagatggacctcctcgaggacgacgacgagttcgaagagttcgagatcgaccaagaatgggatgacaacgaagaaggcaatgaagccgtccagcagtgggaggatgattgggatgacgacgacgtgaatgacgatttctcactgcagctgaggaaagagctggagggaaataatgcccagaagagctgaagtagtatttctctagtttatagatgataaatgattgttatatgccagctactttcggaaccgtgatgtgctatggatggaaagtttacggacatcagtcggcaatgtgacagcactgtacctgttccggtgg

SEQ ID NO: 794 - DNA, 1988 bp, Sorghum bicolor
gctcctcgtgttcgtgctcatctgtggccgtcttgtctccggatgggtcatcaggattgccgtcttcggtgtcgaacgcaacttcttgctgaggaagcgtgtgctctacttcgtgtatggcgtgcgcagcgccgtgcagaacgcgctctggctcggcctggtgcttgcctcttggcacttcttgtttgacaagaacgtccagcaggagacgaactctgcggtgctgccctatgtgacgaagatcttattctgcttccttgttgccacgctcatccgccttgtcaagacattgctggtcaaggtactggcctcatccttccatgtctccacatattttgatcggattcaagaggcattgttcaaccagtacgtcatcgagacactctctgggccgccactagtggatgaaaaccatgtgcttgaggaggtgcatgagctgcaacgtgcaggcgcaactataccaaaggagctgcgtgatgcagtaccaaccaagcatgtgtctgggcaaaggaacattcagttatcaggggtcatgcctaagggagaaggtagcaagcagctgtcaaaggagaaaggggaggggatctctattgatgcacttcataaactcaaccagaaaaacatctcagcttggaacatgaagaggctgatgaggattgttcgatttgggacattaacgactatggatgagcagatacagcaggcaacaggtcagggggatgaatcagcaacacagatacgaagtgaatatgaggcaaagatagctgccaagaagatctttcacaatgtagcaaagccaggttccaagtacatatacttgtcggacatgatgagattcatgaggcaggaagaggctgttaaagcaatggatctttttgaaggagcacaggagcacaacagggtcagcaagaggtctctcaagaactgggtggtgaatgcatttagagagcgtaaagctcttgcccttacacttaatgatacaaaaactgcagtaaacaagctgaaccagatggctaatgtcgttgtggggatcatcgtgtttgctctctggcttcttattctgggaatagcaacaacacatttctttgtcttcctcagttcacagcttctcctggcagttttcgtatttgggaatacattgaagacagtttttgaggcaattgtcttcttgtttgtgatgcatccatttgatgttggtgatcgatgtgaaattgaaggtgttcagatggttgttgaggaaatgaatatcatgacaacggtgtttctccgatatgataacctgaagatatattatccaaacagcgtgcttgcaacaaaaccaattatgaattactacagaagtcctgatatgggagaagcaattgacttctccattcatgttgcaactcctgttgagaaactggccctcatgaaggaacgactactgcgctatattgataacaagaaggaacactggtacccgggtgcgatggttgtactccgagacgtcgatgacaccaacaaactgaaagtatcaatatggctgcggcacacgctcaactggcaggacatgggtatgcggttcgtgaggcgagagctagtgctccaggagatgatcaaagtcctgagggacctcgagattgagtatcggatgctgccacttgatgtgaatgttcgcaatgcgcctgcaattcagtccacaaggatgcctacaacatggagctattcgtgaagcggtgacagggccagaccatttggccgtgacattgcagatgaggacttgctatcttcctccatggatcctggtggcagcgcaagtggtttaagctgcaggtgcttggtaaagcaaatagaggtagagagtagcatattagcatgtagagagagctgttagctgtgcctgcagtcgtcacttgtgcaccttgtaattactgtactctctctttcgtgatgataattttctgtacatttgatggaaaatgacggcttggaaagagaagtaattgaag

SEQ ID NO: 795 - DNA, 2247 bp, Sorghum bicolor
ctctctctcctattcactcctcccagctccagctagcagcagctgctcgcttaaagagggaggaggagaggggcgaggagcaatgtcggagcagcagccattaccgcagcctcggagcagcatgcgggaggcgctggagaaggaggacaaggagaaggccgcggccgccgcggccaaggagaaggcggccgtacccaagaacggcggcaacggtgggggtggcaagaatggcggcggcgtgggtggcggcaacggcggaggcgccccgccgtccggggaggagacggcccgggagattcaggtggtgagggaggcgtaccggcgcgagacggccgcgccggcgtacgtcatccccgaggagccgccggccatggtggagctcgtgggctggtacatctacggcttctgctcctacttcatcacccacctgctgctgccggtgctcttccctgccatcatcacgcaggtcgccttccccaactccgacttcacgccggaccccaagtacaccctcaagggcgtcacctgctccgtccatgagatgtccatgtaccaaaggcttaccaagcactctattgtgattgatgattcccggatgtcaccactgggctggagtggtctatcatgggcaattggcattctcatcgtggcgccgctcctcactcagactgctcaccatcttgaccgtggccaatatcagtcactgatcctcattgctgccacgtcttttgggtcgttcttctgcctgctcacaggcttcttcaagacagtctgggtgttcctgttctacatcctcttcattgcgggctcaatcattattgcggaggcagtgcatacccgcaaccttggactgatgatccgtgggcttgctgcgcatgactcaggcaagcaccttgttcttcgccgccgtgctgctgcgagccagctcagcctgtactgcactgccattggaggcattggagcagccctcatggctgcattcatgtaccacatgctgcggcgcactgatcagctcactggcctctgggttgtgtccatcttctgtggccttatctggttcattggcatttgccatggtctcttcacaaacaggcccagcagctcatcacccaccactgcatttgagcccaacttcttcaccaagctcagctatagtatgacccttctgcgctacccacaggccattggcagcttggttgctgtgttcctgtcctcttttgccacaatgtgcatcttcaccagtggcacactctatgctatcggtggtgtttgcatcaagccagtgcttgtgcttgtgctatggatcctttacttcctgtttcccttgatctcacttccacttctccacccaatccagataataatccgtgctgacgctgttcgcatgcagctgcttggtttcataatctgcctatttgtatctggtgctgggttctacttcaagagccacaggtggagagctgcccacatcattgttatcgcccttgtccagagcactgccaatggcatattgtacgcatttggccgcattctgctccttgatgcctcaccaccagggaaggagggtgcattctcggtctggtatgcatttgtccgtgttactggtgccatgattggcttcgctgcttcttctgctggccctgggcgtgccggaggatcatttgctgctgcattccttgggagcttcctgggcatcattgtgctgatcttcggcaatgtcagcaacattggagcgctgaaggctgctgggcacctcaagggaatggacgatgagaagaggatgggcggacttggggagaaaggtgaaggcatgggtagcgccgtcgctgattcgggtgaaagcagggggagggtatgatgacaattcgtgaaggtgtatttctgggaggggaaaaaagattgcattctgtggaggttgtgtttgtgagaaggatttgttctctttttttttcttgtttcttcatgtttcagtgacactgttaatctcagtgctttgcccgtttgatgcatgatgatggatgacatagtggtagagtgtgctagttgttaatgtgttattcttttgcttgcaagacaattgtaactgatgatcatatggttcttcttcacccgcccaaattctctagcagtcaagcttcattcataattcaatttctgtcgaaaatgtgattgtggcattgtgtagagaaataaacctctgtaaactctgttgtagcgaccatcattccttcaaaagtcaggtgttca

SEQ ID NO: 796 - DNA, 883 bp, Sorghum bicolor
ccggtccggagccgaagaagccggagcgacaagacgacgggcaccgcagcttacctcgccgcgtagggtttccagatgacgacggcggcgcgccccacctgggcgccggccaagggcggcaacgagcaggggggcacccgcattttcggcccctcccagaagtactcctcccgcgacctcgccgcgcacacctccctcaagcccagaaaagacggacaacagacccaagaggagttacagaagaggaacctcagggaggaacttgaggaacgtgagcgcaagcactactcttccaaggataagtcatatgctgaagaaagagaccgacggaaaagttcaagccagctactcttagaagggtcaaagagagaggcggaggataagatagttccacgagaaattgatgcagatgattccgatgtggagcctaaaagtgatgacgaaagtgatgacgatgacgatgatgatgacactgaagctctaatggcagagcttgagaggattaagaaagaaagagctgaggagaagcttagaaaggagcggcaacaagcagaagaggaggccaagatgaaggaggctgagctgatgcggggaaaccctttgatcaatatcaacaatcctagctccttcagtgttaagagaaggtgggacgatgatgtggtattcaagaaccaggcacgtggagagaccaagacaccgaaacggttcatcaacgacacgatcagaagcgatttccaccgcaaatttttgcagaggtacatgaagtgagctagtgcgggcgtgccgtgtacaatttaaacttctctgctgtttgtattgtgatgtttgtgtatgatgagtgaaagatcactattgggctgctgctgtatgaaactctgaagca

SEQ ID NO: 797 - DNA, 1080 bp, Sorghum bicolor
cgccgcacggcagctcgctcgctagctgattatttacgacatccatcacccccaccaatggcgccgcggctgctggcgtgcttcgggcgcaggggcggcggcgcgacggcgtcggcgccggacgacgagggccagcagcaggaggcggcggcggccccgggcccggtgctggtggagctgttcgcgtcgcaggggtgcggggcgtcgcccgaggcggacgccgtggcggcgcggctggcgcaggactccggggacggggacggcgccgccgtggccgtggtggtgctggcgttccacgtcgactactgggactaccgcgggtggaaggaccccttcgcgtccagcgcctggaccgtgcgccagaaggcctacgtggaggcgctccgcctcgacacgctcttcacgccgcaggtcgtcctccagggccgcgcgcactgcgtcggcaccgagcacgacgcgctcgcgcaggccgtccgcgacgcgccgcgataccccgcgcccgccatcaaggtcacgttccagcggccgaacccgacgacgctgcaggcgtcgttcacgggcacgctgcgcagccgcgtggagggccccggcggcgcgagcgtgctggtggcgctgtacgagagcgggctggtgacggactgcgggcgcggcgagaacaagggcaagtctctgctgaacgaccacgtggtgcggcgcctcgagaaggtggccgccgtgcgggagggcgcctcggcgaagaagaccgtgtccggcaccgtccagttcccgctctgggacggcttccgcgccaccaagtgcggcctcgtgctcttcgtccagaacgccgcgctgcaggtgctcggcgtccagcacttcgacctgcctgacaacgtctgagctggtcacggcggtggccggtggggtgcgtgcgcggcgggcaggcgtgaggcgtgtcattctttgtatgtagcgttcgattggcgtgtgtgctgtatctgtatgtagtacattactggatggtatttggaaggaaacctgagtattcttttttttcccacgtatttgttatgtactattatggtaatggattttctgttttgt

SEQ ID NO: 798 - DNA, 1474 bp, Sorghum bicolor
ggcgccggctacgagggaaaagacgtggtggtggagaacctcaggcagctctgcgtgcaccgcgtcgccaacgacaccggccggccatgggcgtggtgggactacgtcatggactacaagatccgctgctccatgaaggagaagaagtacaccaagacctgcgccgaggacgtcgtcaccgcgctcggtttggatctcaagaaggtgctggagtgcatgggcgaccccgaggccgacgccgacaacgccgtcctgtccaaggagcaggaagaccagatcggtagcgggtcgcgaggcgacgtcaccatcctgccgacgctggtcatcaacaacgttcagtacagagggaaactggagcggacggcagtgctgagagccgtgtgcgccggcttcaaggagggaaccgagccccgcgtctgcctcagccatgacatcgagacgaacgagtgcctgcacaggaacggtgggtgctggcgcgacgaggccaccaacgtgaccgcctgccaggacacgtaccggggccgggtgtgcgagtgccccgtcgtgaacggcgtccgctacgagggcgacggctacactgactgcaaagctatcgggccgggaaggtgcgctctgaaccacggcgggtgctggtcggagacgagagggcaacagaccttctccgcctgctcggagaccgcgctgaccgggtgccggtgcccgtcggggttccatggcgatggccacaaatgtgaagacctggacgagtgcagggagaagctggcgtgcacatgcccgggctgccagtgcaagaacacgtggggcaactacgagtgcaagtgcaagggcaaccagctctacatccgcggcgaggacgtctgcatagctaacagcatgtcgaagctgggctggttcatcaccatcgcggccgtggcgtgcgtcgtaggcatcggggttgccggctacgtcttctacaagtacaggctcaggtcgtacatggactcggagatcatgtccatcatgtcccagtacatgccgctggacagccagaacaacgagaaccagcctctgcggcagcacgactcggaagctctgaggcactgaaagggctggcctgacttccctgtgacgtttgcatggagaatctgcacagtaaaccttaggtttcctccggcaaggagttgctgcagggcaccaagctgcacacatgatttcaacagataatctgctgtgatttcgacgatatttgcttcgcttttgtatagcgtagaaaaaagaggacggtttgcacagagcacagagttgagctctagtgagtttagacaggtaggcattttggctcttttgtagtcctgtggatcaagagccgtgtaaagtacacacacagcatttagagaaggcctatacgagctgttatacatgtacacattgtacagtagacaaaccgtacgaagaatttggtactgccatattggtatgtgttggagtttcacct

SEQ ID NO: 799 - DNA, 1206 bp, Sorghum bicolor
ctctcctcgctgtttcggagccccggggccggggggaaggccaacccgaccgtcccaccgcgtcgtctccctcctcgtctcctctcctctcctctcgcgtccgcagcttcccttgcaggctagggtttgcagatgacgacggcggcgcgccccacctgggcgccggccaagggcggcaacgagcaggggggcacccgcatcttcggcccctcccagaagtactcctcccgcgacctcgccgcgcacacctccctcaagcccagaaaagatggtcaacagacccaagaggagttacagaagaggaacctcagggaggaacttgaggaacgcgagcgcaagcactactcttccaaggataagtcctattctggtacacctactttttctgtctcgctcttttgttttctcccttcaggataagtttctgactggtatgtacaatcagtaacaatgtgtatcttcttgcctgcagaagaaagagaccggcggaaaagctcaagccagctactcttagaaggttcaaagagagaggcagaggataagatagttccacgagaaatcgatgcagatgactctgatgtggagcctaaaagtgatgatgagagtgatgaagatgatgacgacgacgacgacactgaagctctaatggcagagcttgagaggattaagaaagaaagagctgaggagaagcttagaaaggagcggcaacaagcagaagaggaggccaagatgaaggaggctgaactgatgcggggaaaccctttgattaatatcaacaatcctggctccttcagtgttaagagaaggtgggacgatgatgtggttttcaagaaccaagcacgtggagagaccaagacaccgaaacggttcatcaatgataccatcaggagtgatttccaccgtaaatttcttcagaggtacatgaagtgatggtaccgctgtgtacaacttacatgtctccgctccttgtatgggagagcattggttcagttgggagctcttatcgttgttatgtttgtgtacgagtgaaagaccagcatagcattggttcagttgagagctctcatcgtgttaagtttgtgtacgagtgaaaggccattattgtgttgctgtatgaaacaaaagtataaacatctgtcggcatcttaacaaagctgtactgagcaatacatatcttatctgaatgtgccaaggtcctatttttct

SEQ ID NO: 800 - DNA, 1028 bp, Glycine max
actctttctcattctctcttcgttctatcaccgaaacccttcttccattaccggcgaacgaagtcggtggcagaaaaggaacaacctcgattcccaaatcgtaaaatccgatgacgaccgctgcaagacccacatgggcacctgctaaaggtggcaatgaacaaggcggtactcgaattttcggtccctcacaaaagtactcttctagggacatcgcatcgcacaccactctcaagcccaggaaggaagggcaggacactcaggatgaattaaagagaagaaacctacgtgatgaactggaagatcgtgaacgaaggcatttctcatcaaaaaataaatcttatgatgacagggatcacggaaagggtagccatctgtttttggaaggttccaagagagacattgaagatcgcattgttgctcgtagtgttgatgcagatgattctgacgttgaagtcaaaagtgatgatgacagtgatgaagatgatgatgatgaggatgacactgaagcattgctggctgagcttgaacaaataaagaaggaaagggcagaggaaaagctacgcaaggaacgacaacaacaggaggaggagcttaaagtaaaggaggcagagcttctgcgtggaaacccactgctaaataatccaacagcatctttcaatgtgaaaagaaggtgggatgatgatgtggtgtttaagaaccagtcccgtggtgaaaccaaaacagctaagcgattcatcaatgacaccatcaggaatgatttccatagaaaatttctgcataaatacatgaagtaagtccttgtgccagaagtccgagttgtttggattttggtctcaacagaacttattaatttgcagtttgtatctaaatgtatgattcaatgttgatggatatatttgtttctcttataaccgtattttaacatgttactcgtagttgctgtaacatggtgtatgcttgttaatgccaactgggtttaagagtcagaccataaaataacattcaatgaagttgtctctctctca

SEQ ID NO: 801 - DNA, 794 bp, Glycine max
aaaattcgcttgtctcaacatttcaactcaactctctaagctgaaatctgaagctaagtttcgttgccactgaggaatgaaatggccaatggtaacaacattagtcatttcttcaagctcttgcttttccttctaactttccactcttgtctcgctgagattttcttccaagagagattcgaagatggatggaagagccgttgggtgctatccgattggaaaaggagcgagggaaaagcgggtaccttcaagcacacagcagggaaatggtctggggatcctgatgacaaaggtcttcagacatataatgacgccaagcatttcgccatatctgcaaagataccggagcttagtaacaaggacagaaccctggtggtgcagtattctattaggtttgagcaggacattgaatgcggtggcggttacatcaagcttctttctggttatgtcaatcagaagaagtttggtggtgatactccttacagtttgatgtttggaccagacttatgtggttcacagacaaagaagctccatcttatactatcataccaggggcagaattacccgattagaaaagatctgcaatgtgaaacggataagttgactcatttctatacatttattctaaggcctgatgcctcttatagtatccttgttgataatcgggaaagagattctggaagcatgtacatggattgggacatccttcctccaaggaaaatcaaggatgtcaaagcaaaaaagccgtcagactgggatgatagagagtacattgaagaccctaatgatgtcaa

SEQ ID NO: 802 - DNA, 1566 bp, Glycine max
aacaaacaaacattcattccattctctctctaaatcgcactcacatcatctcttctatctcctcagtactccggcgatcggagcctctaatccgccacgttctccctatctcctctttctcaactccagaatctcgtcctcgtgagagaaaataaaagttagttagggttacgcacagttgattaattaattaataatagaaaaaatgagctttcaggacatcgaggccggccgttccttcgcttcccggcgaaatctaatcaacggcaaacaagaccccacgcaggcggtggcttccggcatctttcagatcaacaccgccgtctccacgttccagagactcgtcaacaccctcggaacccccaaggacacccccgaactccgcgataagctgcacaagacgagactgcacattggacaattggtgaaggatacttcggctaagcttaagcaagctagtgagattgatcacaacgttgaagttaatgcaagtaagaagatagcagatgcgaagcttgcaaaagattttcaggcggtgttgaaagaatttcagaaggcacagcgtctttcagcggagagggaaactgcttacactccttttgttccgcaagcacttcttccatccagctatacagccagtgaagtagacattggttctgataagactccagaacagcgtgcacttcttgtggaatccagaagacaggaggtattattcttagataatgagatttccttcaatgaggctatcattgaggaaagagagcaaggcattcaagaaatccagtcgcagattggtgaagtaaatgagattttcaaagatcttgctgtgcttgtccatgagcaaggagcaatgattgatgatatcgggtccaatattgagcattcccatgaagcaactgcgcaagcaaaatctcaacttgccaaagcttcaaagacgcaaagatcaaattcatctttgacatgcttgcttctggtgatattcgggatcgtgcttctaatcgtcatcattgttcttgctgcttagtcatagactctggattctattacaaatcaaatgctcttacatactgagttgcagatacgatctcccttgctgatgactacactgaatggtgatttaccagatctcacgaatgaccggaatttgtctcatcaggtttcagtacatgatgtgggaatattcacaacattagtgtatcgttattttggtgggtatatgttctggtttctttgttggtgtttggggctttaaggatgtgtcacaacctgcctgctgtgtatgttatctttttggtttcttaataaacgatatattaattcgttctttacctgtatacgcaacttgaaaattagcatgactgactcttctttagtaataccttgatccattcacccaaaaaaaaaagtaataccttgatccagaatttttttttcctttcctcctcggatttgtggggttcttcccccaaatttggaactttgggatcgttctacaatactcccaactacttattggcggatgcatactccatgtatagattcatgtaactaagattaagagga

SEQ ID NO: 803 - DNA, 632 bp, Glycine max
ccctgcaaaatgagggtgcaggaggagaatccttgttggggtcaatcaaaattgctgtgatgcccatagttaaagtgttcaccatgtgctccttgggactccttatggcttccaagtatgttaacatcttgcctgcttctggaagaaagcttttgaatgggctggtgtttactctcttgctaccttgcttgattttctcccaattgggacaagctgttaccttggagaagatgcttgcttggtggtttattcctatgaatgttgttctgagttccatagcaggctcactcattggttttgttgttgccacgattgtccgtcctccataccctttctttaagtttacaattgtacagattggaatcgggaatattgggaatgttccacttgtcctgatttctgctttgtgtcgagaccaatccaatccctttggagacatggaaaaatgcagcacagatggaactgcctatatatcatttggccagtgggttggtgctatcatcctatatacatatgtatttcaaatgttggcacctcctccagaaggctcatttgagattgataatgaaagtgttcccttaaagagcactccaatgagtgatgctacacctgaacaagctccattgctcgct

SEQ ID NO: 804 - DNA, 1004 bp, Glycine max
gaaacccttcttccattaccggcgaacgaaatcggtgacagaaaagcaacaagcaatctcgatccccaaatcgtgaaatccgatgacgaccgctgcaagacccacatgggcacctgctaaaggtggcaacgaacaaggtggtactcgaattttcggtccctcacaaaagtactcttctagggacatcgcatcgcacaccactctcaagcccaggaaggaagggcaggacacacaggatgaattaaagagaagaaacctacgtgatgaactggaagatcgtgaaaggaggcatttctcatcaaaaaataaatcttatgatgacagggatcatggaaagggtagccatctgtttttggaaggatcgaagagagaaatggaagatcacattgttccacgtagtgttgatgcagatgattctgatgttgaagtcaaaagtgatgatgacagtgatgatgacgaggatgacgaggatgatactgaagcattgctggctgagcttgaacaaataaagaaggaaagaacagaggaaaagctacgcaaggaacgacaacaacaagaggaggagctcaaagtaaaggaggcagagcttctgcgcggaaacccactgctaaataatccaacagcatctttcaatgtgaaaagaaggtgggatgatgatgtggtgtttaagaaccaagcccgtggtgaaaccaaaacagctaagcgattcattaatgacaccatcaggaatgatttccatagaaaattcctgcaaaaatacatgaagtaagtccttgtgccagaagtctgagttgtttggactttggactcaacagaacttattaatttgcagtttgtatctaaatgtatgattcaatgttgatggatatattgtttcctcttataacgctttttaacatgctaatcatagttgctgtaacatggtgtatgcttgttaatgccaactgggtttaagagtcagaccttaaaataacattcagtgaggttgtctctctctcacccta

SEQ ID NO: 805 - DNA, 707 bp, Glycine max
aatatggcggaaaatggttcaattgagctgaacaagtttgtgttgttttgtttgttgttgctaatacaagtggcagtttctgaaatcatttttgaagagcgatttgatgatggatggcgaagtaggtgggtgaaatcagactggaaaagcagtgagggcaaagcaggttcattcaagcacacagctggaaaatgggctggtgatccagatgacaaaggtattcaaacatccagtgatgccaaacactttgccatctctgcaaaaataccagaattcacaaacaagaacagaacattggtccttcagtattctgtaaaatttgagcaagagattgaatgtggtggagggtacatcaagcttctctctggatttgttaatcaaaagaagtttggtggggatacaccatatattttaatgtttggaccagatttatgtggcacggatacaaagaagctccatgtgatactctcctaccacggtcaaaattaccccataaagaaggacctgcaatgtgaaactgacaggttaactcatttctacacattcattctcaggccagatgccacatacagtgtcctggttgataatagagagagagattctggaagcatgtatacagattgggatattcttcctccacgaaaaatcaaagatgtcaaggccaaaaagcctgcagactgggaggaaagagaatacattgaagaccc

SEQ ID NO: 806 - DNA, 1306 bp, Glycine max
tgttctttcttctcagatcccggtggccttttccctccctttctcaggaaaattcccccgattttctcgagaaagtgaaacggaattatgagctttcaggacatcgaggccgggcgccccttcggttcgaggcgcgggttgatgaatgggaagcaagaccccacgcaagcggtggctgccggcatattccagatcaacactgccgtctccaccttccagagactcgtcaacaccctcggaacccccaaagacaccctcgacctccgcgaaaagctccacaagacaagactacatattgggcaattggtaaaggatacatcagctaaacttaagcaagccagtgacattgatcaccatgctgaagttaatgcaagcaagaagatagcagatgctaaacttgcgaaagattttcaggcagtgttgaaagagtttcagaaggcacaacgtcttgcagctgagagggaaacagcgtacactccttttgttcctcaagcagtccttccttcgagctatacagctagcgaagtagatgttggttctgataagtcaccagaacagcgtgccctgcttgtggaatcaaggaggcaggaggttttattcttagataatgagattgccttcaatgaggctatcattgaggaaagggagcaaggcattcaagaaatacagcagcaaattggtgaagttaatgagatcttcaaagatcttgctgtacttgtccatgagcaaggagccatgattgatgatattggctccaacattgagaactcccatgcagcaacagcacaagcaaaatctcaactttcaaaagcttcaaaaacccaaagatcaaattcctctttgacatgcttgcttttggtgatttttgggattgtgcttctcatcgtgatcatagttcttgctgcttagtcaaaggttatctcaattacattatggagcaaatgcatatatactgggcagcagatagcatctcccttgctgatggtgtcacttgattggtgttttgccgggtcttgtggttgactggagtttgttgcatctaatttcagtacatgatgtgggaattcccataattttgttgtggggttttatgttctctctatgttagtgtttggggttttaaaatgtgtcacggattatggtttaagtcctctccttgtttctttaattaaaaaaatatttaattctttgattgtcctttacctgtaaatgcaacgctaaaactggctggctgtgctgactcttcagcaaaaccttcgtatatggtaatctgttgtttcagtgcttttctttcccagaattggaa

SEQ ID NO: 807 - DNA, 735 bp, Glycine max
atcgtcaccaaacaaacattcattcattccacgcttccattctctctctaaatcgcattaccttcttctatctccttagttcccggcgagttcgtgcatcggagcctctaaatcgcattaacatcatcgaatcaaaccttccttctctttctcaactccagaatctcgtcctcgtgagagaaaaaaaaaaagttagttagggttacgcacagttaattaattatttaataatagaaaaatgagctttcaggacatcgaggccggccggtccttcgctgcccgacgcaacctcatcaacggcaaacaagaccccacgcaggcggtggcttccggcatctttcagatcaacaccgctgtctccacgttccagagactcgtcaacaccctaggaacccccaaggacacccccgagctccgtgataagctgcacaagacgagactgcacattggacaattggtgaaggatacttcggctaagcttaagcaagctagtgagattgatcacaatgttgaagttaatacaagtaagaagatagcagatgcgaagcttgcaaaagattttcaggcggtgttgaaagaatttcagaaggctcagcgtctttcagctgagagggaaacagcttacactccttttgttccacaaggagctcttccatccagctatacagccagtgaagtagacattagttctgataagactccagaacagcgtgcccttcttgttgaatccagaag

SEQ ID NO: 808 - DNA, 1562 bp, Glycine max
taaccatggagcacttcaaccatgacgatctcgaatacatcgtccacttccaagacgattttccgacgaaacgggaaagatattcagggaatcccctgggagaggcttaactatagcagagacaaataccgtgagaccagactcaagcaatacaaaaattaccagaacttctctctctctcctcaccacctccacaaggagtgtttccaagtgcagaaggggcaaactttctatgacttcttcttcaataccaggcttgtcaaatccacaattgtccactttcagcttctaaagcaggtggaatatgagcagcttggcaggaccttatattatgctgaggaatttgttgtgggcaacttcaaagcatgatgtataccttatgcaaaattattcagtgatgcactggtccgcattactacaaagaagtaaagaagtgcttaacgtagccaaaccaattattccaacccttacgcatcctggattcttagctcagcctgtctccagagtgcaaataagcaccatgactgttaaggaaaatctgatggtggcaggtggtttccagggtgagcttatatgcaagaatttgaagcaacctggagttctattctgtggtaaaataactacagatggtaatgccataaccaatgccgtggatgtttaccgcaatccagctgggtcgttgagggtaatcacagcaaataatgattcccaacttcgggtttttgatgcagagaattttgcttctcttggttgtttcaagtatgattggtctgttaataacacttctattagtccggatggaaggttgttagctgttcttggggacagtactgagtgcttgatggctgatgctaactctggaaagattactgggagcctaaaggggcacttggactactctttttcatcagcttggcacccaaatggacaaatattggccactgggaatcaggacaaaacatgcaggttgtgggacataagaaatctttcacaatctatggctgtgttaaagggaagaatgggtgcaataagagcactaagattcacttcggacggacgatttttggccatggctgaacctgcagacttcgtccatatttttgactcacattcaggttatgaacaaggtcaagagattgacctatttggtgagattgctggcatatcctttagcccagacacagaagctctatttgtgggtattgctgaccgaacctatggtagcttgttagagttcaacagaaaacgtcactataattacctagactcgttttgatggagtggagtgcctcaagatgtacagcaatctactccatgtgcatatccaccagaggatttctaaaataggtttaaaatatatatggtgaagtgtttttctagggttatttttctgttgaatttagtggagaagcaagttgtaaattttggctctaggaagctatttttgtttctttaatttcaattttattagcgatagaatagctgattagtcttgcctttgtaagaatttccttgcatgctattgtgtattaaaaacaatagcaatatattgctttaaactt

SEQ ID NO: 809 - DNA, 808 bp, Glycine max
aactcaactctctaagctgaaatctgaagctaacttaagggaaatgagatggccaatggcaacactagtcatcgcttcaagctcttgcttttccttctaactctgcactcttcattcgctgagattttcttcgaagagagattcgaagatggatggaagagccgttgggtgctatccgattggaaaaggagtgaaggaaaagcgggtaccttcaagcacacagcaggaaaatggtctggggatcctgatgacaaaggtcttcagacatataatgacgccaagcattttgccatatctgcaaagatacccgagctaagcaacaaggacagaaccctggtgctgcagtattctattaggtttgagcaggacattgaatgcggtggcggttacatcaaacttctttctggttatgtcaatcagaagaagtttggtggtgataccccttatagtttgatgtttggaccagatatatgtggttcacagacaaagaagctccatcttatactatcataccaggggcagaattaccccattagaaaagatctgcaatgtgaaacggataagttgactcatttctatacatttattctaaggcctgatgcctcttatagtatccttgttgataatcgggaaagagattctggaagcatgtacacagattgggacatccttcctccaaggaaaatcaaggatgtcaaagcaaaaaagccggctgactgggatgatagagagtacattgaagaccctaatgatgtcaaaccagagggatatgattcaattccagctgaaatccctgatccaaaagcca

SEQ ID NO: 810 - DNA, 1151 bp, Glycine max
aagcaggtgtctgtcatgaaaagacttcgtcatccaaacattattctctttatgggggctgtgacttcacctcaacatctatgcattgtaacagagtttctcccacgtggaagcttgtttcgtttgcttcagagaaacacatccaaaattgattggagacggcgagttcatatggccttagatgttgcacgaggtgtaaattatcttcatcattgcaacccacctatcatccatcgagatttgaagtcttcaaatattctagttgataagaattggactgtgaaggtcggtgattttggtctttcacgtcttaaacatgaaacatatctcactactaagacaggaaaggggacgcctcaatggatggcaccagaagttcttcgtaatgaactgtcagatgagaagtctgatgtttacagctttggggtgatattgtgggaacttacgaccgaaaagatcccgtgggatactctgaacccaatgcaggttgttggagctgtagggtttatgaaccatcggctagaaattccagaagatgttgatccacagtggacttctataattgagagctgctggcacagcgatccagcttgccgaccagcattccaggaactgttagaaaggctaaaagaactgcagagacggtacacaattgaattccaggcagctcgatctgctgttgaggaaggcactcaaaaggagttctagcaagtggccacaatctttgtgcttgtttctattttatcactaacaggctggtgcataaggaattttacacatatataatacaaaacattcctgatgaatagatgtgttgatacaaataactgctgggcttggagtcctgttgtgttgctggttcatcattatatttgtccagctatcatcctataagtaggaaaatggttaccaaattggttttgtcatgatatttccttgatggcaccatagaagttgttaaacttactagtgatgttttagttgtgaataggttcccattatcatcattgtaattttgtatgggaaatgtttgtgccacttttagttgtatagaaagttggaaaaaagaacaaaagaaatcagtggagacaggaaaatagtaaacagagtgagttcagagagagaatttgagaatgagaaataagtttctg

SEQ ID NO: 811 - DNA, 1722 bp, Glycine max
agttttgctaagaattgactggagagagtcagtacctcaccctgacaacagggttgagtatgagctctggaccaacagcaatgatgaatgtggagctcgttgcgatgaacagatgaatttcgtgaagaattttaagggtcatgctcagattcttgagaggggcggttatactttgttcactccacactacataacttggttttgtccaccacccttcattcttagcagtcagtgcaagtctcaatgtataaaccatgggagatattgtgctccagatccggagaaggattttggagagggatatgaagggaaggatgtggtgtatgaaaatttgaggcagctttgtgttcatagagttgccaatgagagcaaccgttcttgggtttggtgggattatgtgacagatttccatgtcagatgttctatgaaggagaaaagatatagcaaagattgtgctgaggaagtcatgaaatcattagatctgcctgtggataaaattaagaaatgcatgggtgatcctgaagcggatgtggagaatgaagtgctaaagaatgagcaacaagtccagattggtagaggatcccgcggtgatgtcaccatcttgccaacattggttataaacaacgtacagtatagaggaaaattggagagaactgctgtactcaaggctgtatgttccggatttaaggagactactgaaccttcagtttgtttaagtggagatgtcgagactaatgagtgtcttgaaagaaatggaggatgttggcaagacaaacatgctaacataactgcttgcaaggatactttcaggggaagagtttgtgagtgccctgttgtgaacggtgtccagtataagggtgatggttatactacatgtgaagcttttggacctgcaaggtgttctataaacaatggtggttgttggtcagaaactaaaaaaggactaactttctcagcttgctcagactccaaggtaaatggctgtcagtgcccagttgggtttcgtggggatggtactaataaatgcgaagacgttgatgaatgtaaggaacgaagtgcttgtcagtgtgatggctgcagctgcaagaatacttggggtagttacgattgtaaatgcaaggggaacctcctatatataaaggaacaagatgcttgtatcgaaagaagtgaatcaaaatttggacggttccttgcctttgtggtcatagcagttgttgttggtgctggtctagctggttacgtgttctacaaatataggctccggtcatacatggactctgagatcatggctatcatgtcacaatacatgccattggaccagcaaaataatgtagttcatgctgaaactcaacctttacgacaacaaggcaccgtgtaagacatacataatgagctgaaaatagtcaagggaacccgttacactgcataatccgcttcagagacggattataaacagaactggctatatggatttgaatccatttgacagcgaaggaagatcagtattttactgtaggataatcatgtgaacattgcaatatataacagaatttttctgcatagaataatttccattttccacagtttgtaaatagagcttttgagaattgagatgtacatgtacaccttagatagagaataaggatccgtgtgatgttggagtacaatttaaggcaacattgataccaaaagttggcaatacaaatacatcactctggttct

SEQ ID NO: 812 - DNA, 1717 bp, Glycine max
cgtttcttctttcgcaaacctaattactgctattacgagacgacgcagatttagttcggattgttcgattgcgatggctaggaagatgcttatcgatggtgaagctgaattggctcaaggtggtggagaagaagtgtcgaattttgacttcgacttgtttattattggggctggaagtggtggcgttcgtgccgctagattttcatccaattttggagctaaggtggggatttgtgagcttccatttcatccaattagttcagaaacaattggaggagtcggtggaacgtgtgttattcgtggttgtgttcccaaaaagattttggtctatggagcatcttttggaggtgatcttgaggatgccaggaattatgggtgggagttgagtgagaaagttgacttcaattggaagaagctcttgcaaaagaagacagatgaaataaacagattaaatggactttacaagcggatgttatccaattggggggttaaattatttgaaggcgagggaaagatagttggtccaaatgaagttgaggtgacacaattggatggcactaaattgtcctacacagcaaagcacatattgattgcaactggcagcagggctcaacgtccaaatattcctggacaggagttgggtataacatcagacgaggcactaagtttagaggatcttccaaaacatgctgtggttcttggaggaggttatattgcagttgagtttgcatctatatggcgtggcatgggttccacagttgatctagttttcagaaaggaacttccactgagaggttttgatgatgaaatgagagctgcagtggcaagaaatcttgaaggcaggggaattaatttgcatccaaggaccaatttgacacagttgatcaaaacagaggacggcattaaagttattacagatcatggtgaagagctgattgcggatgctgtactgtttgccactggtagggctcctaattctaagaggctgaatttagaaactgtaggtgttgagcttgacaacactggagcaataaaggtggatgagtattcccgcacaagcatacctagcatatgggctgtgggtgatgtcacaaaccgaatgaatctaactccggtggccttgatggaagcatcgtactttgctaaaactgtatttggtgggcaaacaatcaagccagactacagtaatattccctatgcagtgttcagcattccaccactttctgtagttggtctcagtgaggagcaggcaatagagcaaaccaatggggatctgttggtttttacatcaaccttcaatcctatgaaaaataccatctctgggcgacaagaaaaaactgttatgaagcttgttgttgatgctgagacagataaggttctcggagcctcaatgtgtgggcctgatgcacctgaaattatgcagggtattgctgttgcgttgaagtgtggagctaccaaggcacagtttgatagcacggtgggaatacacccatcggctgcagaagaatttgtaaccatgcggtcagtgacaaggcgcgtagctggaactggaagtgtcaaacccaagaccaatttgtaaaatgtttaaaatgaaaatacgatctgcttgatggttgtgtaaagatgcaaatgacttcttttggtgaccttcccattatagtatagatcacaaacacatctgtttttctttcccaataaaatgtttgtttcttttttc

SEQ ID NO: 813 - DNA, 1861 bp, Glycine max
ttagttcgaattgttcgattgcgatggctaggaagatgcttatcgacggtgaagctgaaattgctcaaggtggtggagaagaagtgtcgaattttgatttcgacttgtttattattggggctggaagtggtggcgttcgtgccgctagattttcgtcgaattttggagctaaggtggggatttgtgagcttccatttcatccaattagctcagaaacaattggaggagtcggtggaacgtgtgttattcgtggttgtgttcccaaaaagattttggtctatggagcatcttttggaggtgatcttcaggatgccaggaattatgggtgggagttgagtgagaaagttgacttcaattggaaaaggctcttgcaaaagaagacagatgaaataaacagattaaatggactttacaagcggatgttatccaattggggggttaaattatttgaaggtgagggaaagatagttggtccaaatgaagttgaggtgacacaattggatggcactaaactgtcctactcagcaaagcacatattgattgcaactggcggtagagctcaacgtccaaatattccaggacaggagttgggtataacatcagatgaggcgctaagtttagaggatcttcctaaacgtgctgtggttcttggaggaggttatattgcagttgagtttgcatctatatggcgtgggatgggttccacagttgatctagttttcagaaaggaacttccactgagaggttttgatgatgaaatgagagctgtagttgcaagaaatcttgaaggcaggggaattaatttgcatccaaggaccaatctgacacagttgatcaaaacagaggatggcattaaagttattacagatcatggtgaagagctgattgcggatgttgtactgtttgccactggtagggctcctaattctaagaggctgaatttagaagctgttggtgttgagcttgacaacactggagcaataaaggtggatgagtattcctgcacaagcatacctagcatatgggctgtgggtgatgtcacaaaccgaatgaatcttactccggtggccttgatggaagcatcgtactttgctaaaactgtatttggtgggcaaaaaatcaagccagactacaataatattccctatgcagtgttcagcattccgccactttctgtagttggtctcagtgaggagcaggcaatagagcaaaccaatggcgatctgttggttttcacatcaatcttcaatcctatgaaaaataccatctctgggcgacaagaaaaaactgttatgaagcttgttgttgatgctgagacagataaggttcttggagcctcgatgtgtggacctgatgcgcctgaaattatacagggtattgctattgcattacagtgtggagctaccaaggcacagtttgatagcacggtgggaatacacccatcggctgctgaagaatttgtaaccatgcggtcagtgacaaggcgcgtagccggaactggaagtgccaaacccaagaccaatttgtaaaatgtttaaaatgaaaatacgatctgcttgatggtagtgtaaagatgcaaatgacttcttttggtgaccttcccattactatagatcacaaacccatctgtttttctttcccaaaaaaatgtttgtgttttttttttctttgcgaatttcattttatttaaaattccatatttagaacagtttgattcattggcatataatgtaagaacgagtgattgccgttaattgtggtgcctttagtttcatagaagatatattggagatcgaagaatattttttcttgtgtattatggaatgattggcacatttatttatttatgtgaaggctgaat

SEQ ID NO: 814 - DNA, 1257 bp, Glycine max
aggtgcagttccaccaaatgcaacattgcagattactcttgaattagtttcatggaaaactgtttcagaagtaactgatgacaagaaggtcataaagaagatcctcaaggaaggggaaggatatgagcgtccaaatgagggggccattgttaaagtgaaactaattggtaagctacaagatggtaccgcttttttgaaaaagggccatgatgaagaagagaagctgtttgaattcaaaacagatgaggaacaagttgttgatggacttgatagagctgtattgactatgaagaagggtgaggttgcgttgttgaccattgcacctgattatgctttcggtacatcagagtcccaacaggagttggctgtagttcctcctaactcaaccgtgtattttgaagttgagctagtgtcatttgagaaagagaaggagtcctgggatctgaacactgaagagaaacttgaagctgctggtaagaagaaagaagagggaaatgtcttgtttaaagctagtaaatatgcaagagcttccaaaagatatgaaaaggccgtgaagtacatagaatatgattcctcctttggtgaggaggagaaaaagcaggccaagaccttgaaggttgcctgcaatctgaacaatgctgcttgcaagttgaagttaaaagactacaaagaagcagagaaattgtgtactaaggtgttggaccttgagagtacaaatgtgaaagccctctatagaagggcccaagcacatatgcagttgactaacttggatttggctgaacttgacattaagaaagctcttgacattgaccctaacaacagggatgtcaaattggagtacaggactttgaaggaaaaggtgaaagagaataatagaaaggaggcgcaattttatggaaatatgatcaacaagatgacaaagattggttcctgatagcaataaaccagctacgaagtaccaacggtattgaatccggggttgacaactaaatctagatgtcatccaatatggaacacgaatctgtttagtccccgtttttctggggtttgatcttccttgtatggtttgtgcactaggaaaatttgatggacattcatttcgtatttattatggaatattaacataattgacttaattatatatccccatgaactataatgatttgttcgagagctactataagaatggaattgattaggtcaaggtctgcggggacaacagacaagtgtgtttggattaaataaaaagaacgtctt

SEQ ID NO: 815 - DNA, 1171 bp, Glycine max
gtaaattgctaggatttcatgcacgagagggttcagaacatagaatgttggtttatgaaaggctataccatggaagcttggatcgcttattgtatgggagatctgatgggccatcaattgattggaatacaagaatgaaaattgctatatgtgctgcacaaggtctaaccttcttgcacgaagaggggccttttcaggctatgtataatgagttctcaacagccaacatacagattgacaaagatttcagcgcaaagctttcaggatatggttgtgttggacatattcccgaagaagagatttcaagcagctcatctgctgttggaaacctatcaatggaaacactggagaaaggaatgctcactccaaagagcaacgtatggagttttggaatttttcttctggagctacttactggaagaaagaatcttgatagccgtcaccccaaggaagagaggaatttagtcaagtggagccggcctttcttagccgataactaccgtctgtcgttgatcatggatcctcaactcaaaggccgctttccttctaaagcagcaagaacaatagctgatattgcacaaagatgccttcaaaaggagccatcagacagacctaccatgaggactgttgttgagcatctcaagataatacaggatttgaaatattcgtgccggttccctctgcaagaaccagcatcaaactctggaaaacatatgtcaagatcaccaagtctcaatggcatcatctgccctgcaccaaggttgagtttctcaccatcaccaccatcaggagttccggtatctgtttcgcctccaagatggtctggtggagggcccattctcctcccgccgccacgtgcttgtgcttcgagcctctctttggaggagcttgataggcaggaaagccgcaagtcatcatcctcagcctctagaagggctagtgttgaaggattttgagtgtctataatgttcattttttatttattatattttttttttttggtgtgattcaacacaaaatttataggagataaatgatgtggttcctccacctttaatccctcagtgtgatgccgagaggatgttcttttgtagatagtgcaaaggttggttgactgggttcaattagttacacccatttatatgaaaaattatacggtctttagcatttc

SEQ ID NO: 816 - DNA, 2091 bp, Glycine max
cccttttaaaaccctcttttcttccccctccaccctaacccgattcgcttcttcacatctctcttttcactcaaaactacaaactttatttcctctccgtattctcacatttccacaacatggacgaggatttcgacatggcggcggcggagcccatgggcgaggacttcgacttcgccggcagcggcagcaaccccgtcctgaaggtcggcgaggagaaggagattgggaaagagggtttgaagaagaagctcctgaaagaaggtgaaggatgggacacccctgaagctggtgacgaagttcaagttcactatactgggacgttgcttgatggcacgaagtttgactctagcagagataggggaactcctttcagtttcacgcttggacaagggcaagttattaaaggatgggatcaaggtattataacaatgaagaaaggtgaaaatgcccttttcaccatcccagctgagctagcttatggtgaatctggttctcctccaacaatcccccccaatgcaactcttcaatttgatgtggagctgttgtcttggactagtgtgaaggacatatgtaaggatggaggcttatttaagaagatacttaccgagggagagaaatgggaaaaccccaaggatcctgatgaagttttagtgaagtatgaagcacatcttgaggatggaactcttgtggctaaatctgatggagtggagttcacagtcaacgatggtcatttttgtcctgctttttccaaggctgttaaaaccatgaagaagggagagaaagtgcttttgacagtgaagccacaatatggatttggtgagaagggtaagccagcgcatggtgatgaaggtgcagttccaccaaatgcaactttgcagattactcttgagctagtttcttggaagactgtgtctgaagtaactgatgacaagaaggtcattaagaagatcctcaaggaaggggaaggatatgagcatccaaatgagggagccattgtgaaattgaaagtaattggtaaactgcaagatggtactttatttttgaaaaagggtcatgatgatgaaggagggctgtttgaattcaaaactgatgaggagcaagtaattgatgggcttgacagagctgtgttgactatgaagaagggtgaggtagcattgttgactatagcacctgaatatgcttttggttcatcagagtctcaacaggaacttgcagtagttccacctaactccacattatattacgagattgagctagtatcatttgagaaggagaaggagtcctgggacatggacacaccagagaagattgaagctgctggtaagaagaaagaagaaggaaatgcattatttaaagctggtaaatatgcaagagcttctaaaagatatgagaaggctgtaaagttcatagagtacgatactgcctttagtgaagaggagaagaagagctccaaatccttgaaggttgcctgtaatttaaacaatgcagcatgcaagttaaaattaaaagattacaaacaagcagagaaattgtgcacaaaggtactggaccttgagagtactaacgtgaaggctctttatagacggacccaggcatatatccagttggctgatttagatttggctgaatttgatattaagaaagctcttgagcttgaacctaacaacagggatgtcaagcttgagtacgtgactctgaaggaaaagatgaaggagtacaacaagaaagaggcaaaattttatggaaatatgttcaacaaactgcacaagctagattctcttgacaatagtaaaccagcgtcgaaggatgctcagcccataaatatagacagcaaatcataaacaccatggaaattcatctaatttcgagagtctgctttctttttattattcgtggacatttagaaattttgatggattatgcatgtggatggagacaaattttgtttcgctagttccaagaacgtggaaatcccggcaaaattaaacatttgtgacgttgttctttttcctatatttttgtgtggagtttattgtttcggcatgatcgcgacaacaaaatttcgtttaaaatctactgaactttaaa

SEQ ID NO: 817 - DNA, 1560 bp, Glycine max
agcaaatattgcctattccgcaatatggcggaaaatgcttcgattgagctgaacaagtttgtgttcttttgtttgttggtgctaatacaagtggcagtttctgaaatcatttttgaagagcgttttgatgatggatggcgaggtaggtgggtgaagtcagactggaaaagcagtgaaggcaaagcaggttcattcaagcacacagctggaaaatgggccagtgatccagatgataaaggtattcaaacatccagtgatgccaaacactttgccatctctgcaaaaataccagaattcacaaacaagaacagaacattggtccttcagtattctgtaaaatttgagcaagagattgaatgtggtggaggttacatcaagcttctctctggatttgttaatcaaaagaagtttggtggggatacaccatatattttaatgtttggaccagatttatgtggcacggatacaaagaagctccatgtgatactctcctaccacggtcaaaattaccccataaagaaggacctgcaatgtgaaactgacaggttaactcacttctacacattcattctcaggccagatgccacatacagtgtcctggttgacaatagagagagagattccggaagcatgtatacagattgggatattcttcctccacgaaaaatcaaagatgtcaaggccaaaaagcctaaagactgggaagaaagagaatacattgaagaccctaatgatgtcaaacctgagggatatgattcgatcccaagagaaattcctgacccaaatgctaaagagcctgaaaactgggatgaagaggaagatgggaaatggaaaccaccaaagataccaaatccagcatacaaaggaccatggaaaagaaaggtttgtttatcaagtttgaggagctaaccactatggcacaaacattaatttttccttattctttttcaattttctttcattatccattctctcttacttgtaacctctatgttgacagaaaatcaagaaccctaactacaaagggaaatggaaaactccatggatagataatccagaatttgaagacgaccctgatctttatgtgcttaagcctatcaagtatgtgggcattgaagtttggcaggttaaaggcggttcagtttttgacaatgttttgatttgtgatgaccctgattatgcaaaacaagttgttgaggaagtgtttgccaacagggagattgaaaaggaaggttttgaagaagcagagaaagtaaggaaagccaaagaggaggaggaggctcaaagagcaagagaagaaggtgaaaagcgtagacgagagagaggtcatgatcgacgataccgggacaaatatagagacaaatatagaaggcatcgccaccatgattacgatgatcatgacgagctttgatgggataaaacgtccttctcagttctcacttatttggttgacaagaatttcgagattgttatgaattatagttacgttgatagtccatctcatgttaatttccaagggaaacattttaattttaaataaaaagtagtctatttgctgca

SEQ ID NO: 818 - DNA, 1271 bp, Glycine max
gcagcttggcaggacctaatattatgctgaggaatttgttgtgggcaacttcgaagcatgatgtatactttatgcaaaactattcagtgatgcactggtccgcattactacgaaggggtaaagaagtgcttaacgtagccaaaccaattattccaacccttaagcgtcctggatttttagctcaacctgtctccagagtgcaaataagcaccatgactgttaaggaaaatctgatggtggcaggtggtttccagggtgagcttatatgtaagaatttgaaacatcctggagttctattctgtggtaaaataactacagatgataatgccataaccaatgctgtggatgtttacagcaatcctgctgggtcattgagggtcatcacagcaaataatgatttccaagttcgggtttttgatgcagagaattttgcttctcttggttgtttcaagtatgattggtctgttaataacacttctgttagtccggatggaaagttgttagctgttcttggggacagtactgagtgcttgatagctgatgctaacaccggaaagattactgggagcctaaaagggcacttggactactctttttcatcagcttggcacccagatggacaaatattggccactgggaatcaggacaaaacatgcagattgtgggacataagaaatctttcacagtctatggctgtgttaaagggaagaatgggtgcaataagagccctaagattcacatctgatggacgatttttggccatggctgagcctgcagactttgtccatatttttgactcacattctggttatgaacaaggtcaagagatagatctatttggcgagattgctggcatatcctttagcccggacacagaggctctatttgtgggtattgctgaccgaacctatggtagcttgttagagttcaacagaaaacgtcactataattacctagactcgttttgatggagtggagtgcctcaagatgtacagcaactactccatgtgcatatccaccagaggattcctcaaataggtttgaaatatatatggtgaaatgtttttctagggttatttttctgttgaatttagtggagaagcaagttgtaaattttggctataggaagctatttttgagatttctttaattttgattttattagcgttggaatagctgattagtttttcctttgtaagaatttatttgcttgctattgaatattaaaaggtaatgaaatcaagcaatatattgctttaaaattatttttc

SEQ ID NO: 819 - DNA, 730 bp, Glycine max
tgttctttcttctcagatcccggtggccttttccctccctttctcaggaaaattcccccgattttctcgagaaagtgaaacggaattatgagctttcaggacatcgaggccgggcgccccttcggttcgaggcgcgggttgatgaatgggaagcaagaccccacgcaagcggtggctgccggcatattccagatcaacactgccgtctccaccttccagagactcgtcaacaccctcggaacccccaaagacaccctcgacctccgcgaaaagctccacaagacaagactacatattgggcaattggtaaaggatacatcagctaaacttaagcaagccagtgacattgatcaccatgctgaagttaatgcaagcaagaagatagcagatgctaaacttgcgaaagattttcaggcagtgttgaaagagtttcagaaggcacaacgtcttgcagctgagagggaaacagcgtacactccttttgttcctcaagcagtccttccttcgagctatacagctagcgaagtagatgttggttctgataagtcaccagaacagcgtgccctgcttgtggaatcaaggaggcaggaggttttattcttagataatgagattgccttcaatgaggctatcattgaggaaagggagcaaggcattcaagaaatacagcagcaaaaccttcgtatatggtaatctgttgtttcagtgcttttctttcccagaattggaa

SEQ ID NO: 820 - DNA, 1320 bp, Glycine max
ctttttttccttcttcgtcccagatcccggtggccttttccctctctttctctggaaaattcccccgattttctcgagaaagtgaaacggaattatgagctttcaggacatcgaggctgggcggcccttcagttcgaggcgcgggttgatgaacgggaagcaagacccgacgcaagcggtggctgccggaatattccagatcaacaccgccgtctccaccttccagagactcgtcaacaccctcggaacccccaaagacacccccgacctccgcgaaaaactccacaagacaagactacatattgggcaattggtgaaagatacatcagctaaacttaagcaagccagtgacattgatcaccatgctgaagttaatgcaagcaagaagattgcagatgctaaacttgcgaaagattttcaggcagtgttgaaagagtttcagaaggcacaacgtcttgcagctgagagggaaacagcgtacactccttttgttccacaagcagtccttccttcgagctatacagctagcgaagtagatgttggttctgataagtcaccagaacagcgtgccctgcttgtggaatcaaggaggcaggaggttttattcttagataatgagattgccttcaatgaggctattattgaggaaagggagcaaggcattcaagaaatacaacagcaaattggtgaagttaatgagatcttcaaagatcttgctgtgcttgtccatgagcaaggagccatgattgatgatattggctccaacattgagaactcccatgcagcaactgcacaagcaaaatctcaacttgcaaaagcttcaaaaacccaaagatcaaattcctctttgacatgcttgcttttggtgatttttgggattgtgcttctcatcgtgatcatagttcttgctgcttagtcaaagattgtctcaattccattatggagcaaatgcatatatacagggaagcagatagcatctcccttgctgatgatgtcacttgattggtgttttgccgggtctggtggttgactggagtttgttgcatctgatttcagttcatgatgtgggaattcccataattttgttgtgtggttttatgtgctctctatgttagtgtttggggttttaaaatgtgtcacggattatggtgtaagttctctccatgtttctttaattaaaaagtatttaattctttgattgtcctttacctgtaaatgcaacgctaaaactggctagctgtgctgagtgctggctcttcggcaaaaccttcgtatatggtattttgtttttgttttagtgcttttctttttcagaattgg

SEQ ID NO: 821 - DNA, 1678 bp, Picea sitchensis
gctctgcaattcgatctccgctggcccaagtcgccggatcgaatccccttcccaaaatccgtaaaagcatcgatacagcccttgcgggttctttatatttgccttcgtctctgaattctacggaatccaaagtttttcgccgtaatttctgacctgtattgtccccaattgagtttcaagatcatttatagcgcgtttggcttcttcgagctgaccagaacaagatctggtgggcaggagttcggccgcttgaaacttttgtaggttttcagaaggagggcattaaagggatcgcttagttttggtcgatcgggggaaaatgagctttcaggatttagaatcgggccgccccttgtccataaggagagaggctattaatgggaagcaagacccgtctcaggccgtggcttccggtgttttccaaatcaatactgccgtttcgacgtttcagaggcttgtcaataccctcggaacgcctaaggatactccagaactcagggagcgattgcataagactaggcaacacattggacagctggtaaaagacacatctgcaaaactgaaagctgccagtgaaactgatcagcatacggaagtcagtgcaaacaagaagatagcagatgcaaaacttgcaaaagattttcaagctgttctaaaggagtttcagaaagcccaacggcttgcagctgaacgtgagacagcttatacaccttttattccccaagcggttttgccttcaagctatatcgcaagtgaactgggtttaagtccagacaaaactcaggagcagcaggctctcctcatagaatctaggagacaggaagtccttcagttagagaatgaagttgtatttaatgaagcgattattgaagaacgggagcaagggttacaggagattcagcaacaaattggagaagtcaacgagatatttaaagatcttgcagttcttgttcatgagcaaggagtcatgattgatgacatcgattctaatattgagagctcatattctgcaactgtacaagctaaaagtcaacttgccaaagcttctaagagtcaaaagtctaactcatctttgacttgcttgctactcgtaatttttggcgtggtgttgcttattatcatcatagtacttgcagcataattggtgacctgttcgagtgtcaatctggtatcatttctttttttgatctacaacggtgtctgcagcttggggtgggacaaacttggacctgtttactatttcttgggtacaatttttgatgtatctgaaaggctgggtccttttctctgtattcaataccccgcatatttccttgctttttggcaggtggcataggttttatgacaaggatggttagtgttatgattcattttgtattgagagatgaaaagctagtcgtgtgtattatgtatagttcgagtcatttgtttgatagtggtaggtaagtatttaagtatgcacaaggttgttttgtgcttagtaatgaattgctgttttaaagtttgtgcagctgtagttatgcttgttggggaagccattgtttcgttatgtatctactatttattgttctatcactaacaaattcgttaaactgctgggattgtgacaggataataaattttattcttttgcttctctcaaaaaagtttactaataaatcgtaccctttcctgctta

SEQ ID NO: 822 - DNA, 1352 bp, Euphorbia antiquorum
gagtattcagaggatgccattgatgcttttagacaggaggtatctctgatgaaaagacttcggcatccaaatgtattacttttcatgggtgcggtcacttcacctcagcgtctctgcattgttacagagttccttccccgtggaagtttgttccggttactccagaggaacacaacaaaattggattggagacggcgtgtccatatggcaatggatatagtacggggtatgaattatcttcatcatttcaatccaccaattatccaccgtgatttgaagtcttcaaatcttttggttgataagaactggactgtaaaggttggggattttggtctatcacggctcaagcatgcaactttcttgactactaagactgggaggggaacgcctcaatggatggcgycagaggttctrcgtaatgaaccatcagatgaaaagtctgatatatacagctttggagttattatgtgggagcttgccactgagaagatcccatgggataatcttaactcaatgcagktgatcggagctgttggatttatgaatcaaaggttagagatcccaaaagatattgatccacaatggtcttctataattgaaagttgctggcacagtgatcctcagagccgtccaactttccaggaactgttagaaaaattcagagatcttcaaagacaatacacaattcaattccaagcagctcgttctgcagctggagatgccgcacaaaaagaagtattatagaccaaaatcccatttaaatacataattatacatctaaacctgttatatttttccgtttggcaccctttatttatacttggaatctcaatcacccccctacttgttactttttaccatttagtayctraacttgtaaattttgtgcctataacatccctatttgctccaaataggctctaaatagacaagttaagggtgctaaacaacaaaaagttacgagtttaggtatgttgtggatccaaatataaatagaggatatcaaattgcaaaatattgcaaagttttaggtgtgtaattacgtatttggtccaaaaattccattttttttctctatatgggatttgtttggttgacaaggcacagaaaaaagaagacaactttacctatttaaaacaagtatttttctggcaatttgtggtcagaaaggtgaaaacgattgcccacaaatagccacttaaaaagattagtggagaaaaaaatatgaggaagtagttggcatccatgtgagctgggacctaaggttgatggtgattgattgattttgtttgatgtttgttaataataataatattattaactgacatcattaaaatctacgaaaatccatc

SEQ ID NO: 823 - DNA, 865 bp, Euphorbia antiquorum
catacacattgcgtattctctctttaaactcaaaagattattctcacttttcattcgattcgaactcagtttcgtctgatctccgattctctgttctccgtcgccgatttcccgagaaagtgatcgggaattgtttgatttgtttctaggttttgtgtaatttaaatatgagttttcaagatctcgaggccgggaagccatttgcgagttctcggagagacctaatcaacggcaagaaagattccactcaagcggtggtttctggaatcttccagattactacctatgtttcaacgtttcaacgtcttgttaatacccttggcactcccaaggatacccccgagctccgtgagaagctgcacaagacaaggctgcatattgggcagttggttaaggatacttctgcaaaacttaaacaagcaagtgaaactgatcatcatgctggagttagtcaaagtaaaaagattgctgatgctaaactcgcaaaagattttcaagcagttttgaaagaatttcaaaaggctcagcggcttgctgctgaaagggaaacagcttatacccctttcgttccccaggcagttgttccctcgagcttcaaagctgctgagatggactcaggtttggaacaaattcaggagcagcgccctcttgtacaagccacaagacaggaggttttgctattggacaatgaaattgtcttcaacgaagcagtaattgaggaaagagagcaaggaatacatgaaattcagcagcaaattggcgaggtcaatgagatttttaaagatcttgctgtccttgttcatgagcaaggagttatgatagatgatattggatctcatcttgaaaattcccaagctgcaactgc

SEQ ID NO: 824 - DNA, 1264 bp, Euphorbia antiquorum
ggggttaaactatatgaaggagcaggaaagatcgttggtcctaatgaagttgaggttacacagctagatggcactaaattaagctactcagcaaagcacatacttattgccactggaagtagagctcaacgtcctcctattcctggacaggagctggcaataacctctgatgaagctttgagtctggaagatgttcctaagcgtgttgttatccttggtggagggtacattgctgttgagtttgcttcaatatggcgcggcatgggtgctactgtggacctagttttcagaaaggaacttccattgagaggttttgatgatgaaatgagggcagtggttgcaaggaatctagaaggcaggggaataaatttgcatcctagaacaagtttgagtcagttgrttaaaacagaggagggcataaaagtaacgacagatcatggagtagatatcttggcagatgttgtactctttgccactggtcgggcacccaatacaaagatattaaatttgggttcagcaggcgtggagcttgatagtgcaggggctattaaggttgatgagttctcccgcaccaatgttcctagcatatgggcaatcggtgatgttacaaatcgaatgaatcttacccctattgccttaatggaaggaacatgctttgcaaaaactgtttttggtgggcaacctagtaaacctgactacaaagatgtaccatatgctgtatttagcattccaccrttgtctgtggtaggccttagtgaagaacaggcaatagagcaaggcaaaagtgatatattggttttcacttcatccttcaatcctatgaagaacactatctccggacgacaagaaaagacagtgatgaaacttcttgttgacgctgagacggataaagttcttggagcttccatgtgtgggccagatgctcctgaagttatacagggaattgctgttgcattgaaatgtggagcaacaaaggcccaatttgacagcacggtgggaatacacccttctgcagcagaggaatttgtgaccatgcgcacagcaacaaggactgtttctggtagcaacaaacccaagaccaacctatgaagcagcagcttataagaagataatagatataaaattccgtgtgatgatttaaaaaaaattgttgaaagcaagcattttcttttctcaaaggtaacatagaccatcttgctttcatgaaaaagaatattgattcaattcaaattttcccaaataaatccagttagttcctatacat

SEQ ID NO: 825 - DNA, 802 bp, Fragaria  ananassa
caaaaacaaaactctagtgatccagtattcgattaaatttgagcaagacattgaatgtggtggtggctacatcaagcttctatctggctatgtgaatcagaagaagttcggcggtgataccccatacagtttcatgtttggaccagatctatgtggctcacagaccaaaaaactccatcttatactttcttaccaggggcagaattatcccataaaaaaggatcttcaatgtgaaacagacaagttaactcatttctatacatttattcttagacctgatgcaacttacagtgtccttgttgataatcgagaaagagattctggaagcatgtatactgattgggatatacttcctccacggaaaatcaaggatgtcaatgcaagaaagccatcagactgggatgacagagattacattgaggacgtcaaagctgccaaaccagagggatatgattcagttccatcagaaattcctgatccaaaggccaaagagccagaggactgggatgaggaagagaacgggttatggagaccaccaaagatcccaaatccagcttacaaggggccatggaagcgtaagaaaatcaagaaccccaactataaggggaagtggaagactccgtggattgataacccagagtttgaggatgatcctgacctttatgtgctgaagccaataaaatatgtgggcattgaagtttggcaggtaaaagctggttcagttttcgacaacattttgatttgtgatgatccacagtatgcaaaacaagtggtagaagagatattttctatagagaggctg

SEQ ID NO: 826 - DNA, 1257 bp, Fragaria  ananassa
gtcctgcattgtccaaggctgttaaaaccatgaagaagggggagaaagtattgttagcggtgaaaccacaatatggatttggggacaagggtaaagctgcatctggtgatgagggtgctgttcctccaaatgcaactcttcatattactctagagttggtatcatggagaacagtctcagaactgacagatgacaagaaagttattaagaagatcctaaaagaaggagaagggtatgagcgtccaaatgaaggggctgttgttacagtgaaattgattggaaagttgcaagatggtacggtatttttgaagaaaggtcatggtgaaggagaagaaccatttgaatttaagacagatgaggagcaagtcattgaggggcttgataaagctgtagtcacaatgaagaagggtgagatagctcttgtgattatagcccctgagtatgcatttggcgtgtcagagtccaagcaggagttggcagtggtgcctcctaattcaactctttattatgagattgagcttgtatcttttgtcaaggacaaggaatcatgggacatgaatactccggagaaaatcgaggctgctggcaagaaaaaggaagaagggaatgctttcttcaaggctggtaaatatgcaaaagcttccaaaagatatgagaaggctgtgaaatacattgaatatgatacagcttttgctgaagaggagaaaaaacaggctaaggcgttgaaggttgcttgcaatctcaatgatgccgcttccaaattgaagctgaaagagtacaagcaggctgaaaagctgtgtaccaaggttttggagcttgagggtaggaatgtgaaggctctgtacagaagagctcaggcatatatccagctggcagatctggatttggctgagcttgacatcaagaaagctcttgaaattgaccctaacaacagggatgtgaagctggagtacaaaactttgaaggagaagatgaaagaattcaacaagaaggaggcaaagttttatggtaacatgttcgccaaactgaccaaggattccgataaggatgctgaacccatgagcgtggacagcaaggcataggcgggcgggaggaagtgcaaatttgcattacctgctactacttcgagttaggtttttactacaacttggccaggcacaagatctattttctttgtgttctcgtaaaaaacaattgagctagttttccttgtctgcttgtacgcctgttgatttatattttatctccgcttgaagc

SEQ ID NO: 827 - DNA, 855 bp, Fragaria  ananassa
atcatcgcctcgtgcttagctaacctttctgtgccctaattctttattccaatcgaggtttccagaaccctgtacccaaattctcacttctctcttctcgaaattctcgccggaatcgttctcgggggaagcgctaagcgtttggggaaggcggccgagatgagctttcaggattaccgggatctggaagcgggccgcgggtcggctcagtccaggcgcgacccgacccaagccgtcgcctccggcattttccagatcaccaccgccgtctccacgtttcagaggctcgtcaacaccatcgggacccccaaagacacgcccgagctccgcgagaagctgcacaagacgagactacatattggccaattagtaaaggatacttcagagaaacttaaactagcgagtgaacgagatcaccatactgaagttaatggaagacagaaggttgcagatgctaaacttgccaaagattttcaagcggtactgagggactttcagaaagctcaacgactgtcagctgagagggaaacagcatatgctccttttgttccccaggctgttcttccatcaagctacactgctagtgagatagatacctcagataagagtccagaacagcgtgctctccttgtagaatcgagaagacaggaggtcttgctgttagacaatgaaattgcctttaatgaggctatcattgaggaacgggaacaaggaatacaagagatccagcagcaaattggagaagtgaatgagatttttaaagatctggctatcctggttcatgaacaaggaaccatgatcgaggatattgactctaatgttgagagtgctcacgctgcaacttcccaggcaaag

SEQ ID NO: 828 - DNA, 1112 bp, Saccharum officinarum
  misc_feature (1)..(2): n is a, c, g, or t
  misc_feature (6)..(7): n is a, c, g, or t
  misc_feature (11)..(11): n is a, c, g, or t
  misc_feature (46)..(46): n is a, c, g, or t
  misc_feature (57)..(57): n is a, c, g, or t
  misc_feature (63)..(63): n is a, c, g, or t
  misc_feature (66)..(66): n is a, c, g, or t
  misc_feature (978)..(978): n is a, c, g, or t
  misc_feature (1108)..(1108): n is a, c, g, or t
nngcgnncgantgagcgggaaggtggcagtggtgagagttttttcncggatcgtggngcaaangangagccgacgtcttgtgtaacaaatacaccaagacgggatgcaccacatggtccctttgctacacaagagaactcccctgggaaatcaacgaacccaaacagcgatgaatcagaaggaaaagtaggtctgcacaagattttgagttcaaaggcagaggcactactgaacaagaaagggatatcatggccttggaaagggcgygaaaatgagggacctgatgaaagaaatcatgtgatattgccatggttgcayggtgaccaagagaatggtatgaatcatcaraaggtttctgattctagcrtagctccagatgcccaaggcgctgaayacaaccaacctaacaaaaatgaggcatcaggttcctggtcctctttcaacaataacagcacaagcagtgcaagcagcacgggaagcactaatagcagtgctctctacaaagtagatcatgaagcagattgtctggattatgagatcctgtgggaagacctcgtcattggagaacaaataggtcaaggctcttgtgggacagtataccatgctttgtggtatggttcggatgtggctgttaaagttttctccaagcaagaatattcagaagaagtgatactgacctttcgacaagaggtatcccttatgaagaaactacgccatcctacatactgytcttatgggtgcggtcacatctccacaacgcctttgtattgtaacagagtttctccctcgtggaagcttgtttcgcttacttcaaaagagcgctaccaagttggatgtgagacgacgtgttcacatggctttagatattgcaaggggcatgaattatcttcaccattccagcccacctatcattcatcgagatttaaaatcatctaatctgttggttgacaagaactggactgtgaaggtggcagactntggtctttcacgtctcaagcgtgaaactttcttgacaacaaaaacgggaaaaggaacacccgcatggatggcgccagaggtgttgcgcagtgaaccttccgatgagaagtctgatgtgtatagttatggngtta

SEQ ID NO: 829 - DNA, 805 bp, Saccharum officinarum
  misc_feature (446)..(446): n is a, c, g, or t
ctccggcgatgggcactcgccgcggcggcggcgtgcttcacggcctcctcgccctctcgtcgctgctgctcctcgcttccggtgagatcatcttcgaggagcgcttcgaagatggttgggagacccggtgggtagaatccgattggaaaaggagtgaagggaaagctggaaggttcaagcacacagcgggaagatactctgcggatcttgatgacaaaggaatacaaacaacaatggatgctagacattttgctatctcagccaagttcccacaattcagtaacaagaaccggacacttgtggtccagtactccattaaatttgagcaggatattgaatgtggtggtggctatattaagcttatgtccggttatgtcaaccagaaaaaatttagtggggacactccatacagcttgatgtttggaccagatatatgtggtactcanacaaagaagctccatcttatactctcttaccaggggcagaactatcccatcaagagagatctagaatgtgaaacggacaagttaacacatttctacactttcattcttaggcctgacgccgtctatagcctacttgttgacaaccgtgaaagagaaactgggagcatgtacactgattgggatatccctccttcctcggtaaataagggatgtcaggccaaaaggccctagggattgggatgacagagaatatattgaagatcctgatgaagaaaagccagaggctatgattctatccaaaacagattcttgatccgaggccaaaaagcctgacccatgggataggaccagatggaata

SEQ ID NO: 830 - DNA, 958 bp, Saccharum officinarum
  misc_feature (957)..(958): n is a, c, g, or t
cgacgagccgacgagctctacttcccttccggccttgggcgaccgtgacgagcaacgacgaccacggcgacgatggccgcttcctccctctgccgccggcacctgctcctgttcctcctcgtggccgtcgcgtcggactgcctcggcaccgcggcagcgcatcaagccggatctggagaggggtacacgatcgccggccgcgtcaagatcgatggcgcgagtgcgaagggctttggtcttccagccaagacatcaaacacaaaagtgatacttaatggcggccagagggttacatttgccaggccggatggttactttgcattccacaacgtgccagctggaactcatcttattgagatctcctcaattggctacttcttttccccagttcgagtagatattagtgcaaggaatcctggttatattcaagcagcattgactgaaaccagaagagttctaaatgagcttgttctggaacctctgaaagaagagcagtactatgaggttagggagcctttctccgtcatgtcacttttgaagagccccatggggttgatggttggttttatggtcttaatggtcttcgtgatgcccaagctgatggagaacatagatcctgaggagatgaagcaagctcaagaacaaatgaggaacaaccccgtatcattctctggcttgctatccagagcgcagggctagaagtagaacatgaggatactgcaaaggtctatatattctacaatgtgattaagagcattactaaagtgcttgacatggcactcactcagagtaatttcctggggacaaggtggaaactctttcccctgtttttactgtattttaagctgtaatttgtctgtgatgtagaaccttcagaaacctctagcagattgagatgttttatccaatatgtattgtttgaatcagttgaatcttagacaccttgcttagtcatcnn

SEQ ID NO: 831 - DNA, 627 bp, Saccharum officinarum
  misc_feature (555)..(555): n is a, c, g, or t
  misc_feature (592)..(592): n is a, c, g, or t
ccggacaggatggcgctgaagctggcgccgtgcgcgtccgcggcgcagaaccccagctccgcgccgtccagctcctgctgcaacgcggtgcacagcatcgggaagcagagtcccaagtgcctytgcgccgtcatgctgtccaaaacggccaagagcgctgggatcaagcccgaggtggccatcaccatccccaagcgctgcaacctcgtcgaccgccccatcggctacaagtgcggggattacactctgccatgagctgcgagagctacttgcattgagcacgtgttcatgatccgtcggagttagcacgacgtctgtgggaagtgacggtgacgtgtcagtgtatgtgtgtgttgccagtaaacgagacttgtgattaccatacatgtggaactccagtatgatatggctgggtgtctcactagatacgtatgtacttgtactctcttgtagtcaggttcagggtgttccagagatgctgtcctgaatcctcgaaataaaacttgtctthttggacaaatttggttaaaaaaaaagggaaaacgagggaacgcnagcctgggcccggcagggcagggcaacggaggggcanggggggggcgcgggggggggacccacgggaattgg

SEQ ID NO: 832 - DNA, 1932 bp, Saccharum officinarum
  misc_feature (1867)..(1868): n is a, c, g, or t
gcgaggcggaatcggagtcgctcaaggtcacagctcacaggtgactcacgattccagcgacagcaggagggaagcaccggaaacgaagccgagaggatcgaaccttccgattcgtgtgccctccgtatcaagatcacagggttgtgtttgaatcgcgggcgttgggaacccatctatggcgaggaagatgctcgtcgacggggaggtggcggccgtcgcggacgccgggcagtacgactacgatctcttcgtcatcggggcgggcagcggcggcgttcgcggctctcgcttcgccgcctccttcggagctaaggttgcgatttgtgagctcccattccaccccatcagctcagagtggctaggaggacatggtgggacgtgtgtgatacgtggttgcgtacccaaaaagatacttgtgtatggtgcatctttcagtggagaatttgaggattcaaagaatttcgggtgggagattaatggagatattaacttcaattggaaaaagctgttggaaaataagactaaagaaattgttagattaaatggagtgtatcagaggatccttaccaatgccggtgtgacaatgattgaaggggcaggcagtctagttgatgctcatactgttgaagttagccagcccgatggttcaaagcaaaggtatacagcgaagcacattttgattgcgactggtagccgtgctcaacgtgtcaacatacctggaaaggagctggctattacttcagatgaggccttgagcttagaggagcttccaaagcgcgctgtaatcctcggtggcggatatattgctgttgaatttgcttctatctggagggggatgggtgctgaagtagatctgttttatcgaagggagcttcctctaagaggttttgatgatgagatgagagctgttgttgcaagcaaccttgagggaaggggaatcaaattgcatccagggacaaatctgtctgagttgagtaaaacggctgatggcataaaagttgtaactgataaaggagaagagctcattgcagatgttgttctatttgcgacagggcgcacaccaaactcccagagactgaacttgcaagctgcaggcgttgaggttgaccagattggcgccatcaaggttgacgaatattctcgtacatctgctcctagtgtatgggctgtgggtgatgtaacaaaccggatcaatctaacacctgttgcattgatggaggcaacttgctttgccaaaactgtgtttggtggccagcaagttaagcctgattacggagatgttccttgtgctgttttctccattccaccactatctgtagtgggcctcagcgaacaacaggccttggaggaagccaatggcgatattcttgttttcacctcatcattcaacccaatgaagaacagcatatccaagcgccaggagaagactatcatgaaactggtagttgatgctgaaactgacagagtacttggtgcatccatgtgtggaccagatgcacctgaaattatccagggcatcgctattgcgcttaaatgtggagccaccaaagcgaacttcgacagcactgtcggaatccacccttctgctgctgaggagttcgtgaccatgcggaccgtgacaaggcgcttgagcccgacatcgaagccaaagacgaacttataagcaagatttggtgttttagggaatgatatacgctacacaaatattctggtttcattttggtaattttacgtcattggaactgtaacactgtatattgaaggaataggatttttccttgacagtccacacaagataatgagatcgtgaagtttcatgatctaaataaaagctcaagctgagacctgaggatgtttacggtttgcnnaaaacaacaccacaacccccaccaaccgcagacccacttaacccccccgcctcctcacacaaac

SEQ ID NO: 833 - DNA, 1284 bp, Saccharum officinarum
agcgccgagatggaggacgcctgcgccgcggccccgcgcttcgccgacgtgccggtgcgcctgctcgccagccgccgcgacctcgacggcctgggcctcgacgccgacgcgctccgcctgccggcgcacctgttcggcgtcttcgatggccatggcggcgccgaggtggcgaactactgccgggagaggctccaggtgctgttgcggcaggacctgaggctactcggcaaggatttgggggagacagcagaggtggacatgaaggagcactgggacgagctgttcaccaggtgtttccagaggctagaagacgaggtgtcggggcaggcgagcaggctcgtcgatggagtccaggagtcacggccggtggctgccgagaacgtgggctcgactgcggttgtcgccgtcgtgtgctcgtcccatgcggtggtcgccaactgcggggattcgcgtgccgtactctgccgtggaaaagagcccgtaragctgtcgattgatcacaagcctgacaggaaggatgagcgggcgaggattgaggccctgggaggcaaggtcatccaatggaacggctaccgggtctccggtatacttgctatgtcgagatcgattggggaccggtatttgaaaccattcgtcattccaaaaccagaagttacagtctttcctagggcgaaagatgacgactgcctcattcttgcaagtgatggactgtgggatgtagtgacaaatgaagaggcatgcaaagttgcgcgtcggcaaatccaaatgtggcacaagaacaatagtgtcacatcatcattgtgtaatgggagtgatgaatccactgatcctgctgcacaagccgctgctgattatcttatgaggctcgcactgaagaagggtactgaggacaatatcactgtaattgtggttgacttgaaacctcgaaagaagctcaagagcaacccataacattgagctggatccatcagagtagagctgaccatgatatgtccaaagacttatactgctagttggtcgtccgcatgagacttgacccacagttttttttcgttgggcctctagaattgtacatgtatatgctagatgcattttccatagagggttatgatgcttaaccccactctggtttctggtggtttaaatattctccaatcggcttctaccttgagccctggcacttggtataatccccaatgctgtatgatagtcgaacttgtaaagagccaagcggctgagacggttactaaaattaacatattgttaccttaatgattcaaggcc

SEQ ID NO: 834 - DNA, 1075 bp, Saccharum officinarum
ccttcctctccttgctgtctcatagccccggggagaggccaacccaacccgaccgcgtcgtctccctcctcctcacctctccgcagcttcccttgtcggctagggtttgcagatgacgacggcggcgcgccccacctgggcgccggccaagggcggcaacgagcaggggggcacccgcatcttcggcccctcccagaagtactcctcccgcgacctcgccgcgcacacctccctcaagcccagaaaagacggtcaacaaacccaagaggagttacagaagagggacttcagggaggaacttgaggaacgcgagcgcaagcactactcttccaaggataagtcctatgctgaagaaagagaccggcggaaaagctcaagccagctactcttagaaggttcaaagagagaggcagaggataagatagttccacgagaaatcgatgcagatgactctgatgtggagcctaaaagtgatgatgagagcgatgaagatgatgatgacgacgacgacactgaagctctaatggcagagcttgagaggattaagaaagaaagagctgaggagaagcttagaaaggagcggcaacaagcagaagaggaggccaagatgaaggaggctgaactgatgcggggaaaccctttgattaatatcaacaatcctggctccttcagtgttaagagaaggtgggacgatgatgtggttttcaagaaccaagcacgtggagagaccaagacaccgaaacggttcatcaacgataccatcaggagtgatttccaccgtaaatttcttcagaggtacatgaagtgatggtaccgccgtgtacaactttgatgtctccgcgccttgtatggcagagcattggttcagttgagagctcttatcgttgttatgtttgtgtacgagtgaaagaccagcagagcattggttcagttgagagctctcatcgtgttatgtttgtgtacgagtgaaaggccattattgtgttgctgtatgaaacaaaagtataaacatctgtcggcatcttaacaaagctatactgagcaatacatatcttatctgaatgtgccaaggtcc

SEQ ID NO: 835 - DNA, 854 bp, Saccharum officinarum
  misc_feature (851)..(851): n is a, c, g, or t
atccacaggaaaagaaaggccgcgacgagccgacgagctctactccccttycggccttgggcgaccgtgacgagcaacgacgaccacggcgacgatggccgcttcctccctctgccaccggcacctgctcctgttcctcctcgtggccgtcgcgtcggcctgcctcggcaccgcggcagcgcatcaagccggatctggagaggggtacacgatcgccggccgcgtcaagatcgatggcgcgagtgcgaagggctttggtcttccagccaagacatcaaacacaaaagtgatacttaatggcggccagagggttacatttgccaggccggatggttactttgcattccacaacgtgccagctggaactcatcttattgaggtatcctcaattggctacttcttttccccagttcgagtagatattagtgcaaggaatcctggttatattcaagcagcattgactgaaactagaagagttctaaatgagcttgttctggaacctctgaaagaagagcagtactatgaggttagggagcctttctccgtcttgtcacttttgaagagccccatggggttgatggttggttttatggtcttaatggtcttcgtgatgcccaagctgatggagaacatagatcctgaggagatgaagcaagctcaagaacaaatgaggaacaaccccgtatcattctctggcttgctatccagagcgcagggctaraagtaaacatgaggatactgcaaaggtctatatattctacaaggtgattaagagcattactaaagtgcttgacatggcactcactcaaagttatttcctgggggacaagtgggaaactctttcccctgtnttt

SEQ ID NO: 836 - DNA, 640 bp, Saccharum officinarum
  misc_feature (623)..(623): n is a, c, g, or t
gtggtcacctggtccctgcagtacggtcggaatcccgggttcgaccacgcgtccgcgcatactggttcttccgtgttcttcgcgtgcgttctgtctctatagcagcgtacgcgaccgccggcgctagcgccgccgttcgctaggtttccagatctccatcttcttgctcgggcccttcaccggcggcgagcacccaccagtgttgcgagtcccgatggcggaaccagcgaagcccgaggtgacggaggaagctaagatggacctgctcgaggacgacgacgagttcgaggagtttgagatcgatcaagagtgggatgacaaggaagaaggcaatgaagcacttcagcaatgggaggatgactgggatgatgacgatgtcaatgatgacttctcgctgcagctgaggaaagagctggagagcaatgcgtccaagaactagctagcatttgcattttgcaactgttatttgttctggaccttggcatggccactttggtgtagtcactgcatatgctgtcgttaatgccttgattactgaaagaactattttccaagttatattaacctgctttcatcatctgataataatcccgaatttgatcggtctattgagaagtccaaanacccccccccccccccc

SEQ ID NO: 837 - DNA, 2354 bp, Saccharum officinarum
  misc_feature (2073)..(2074): n is a, c, g, or t
  misc_feature (2107)..(2108): n is a, c, g, or t
  misc_feature (2114)..(2114): n is a, c, g, or t
cagtcccgttcccgtccatcaaccggttctccacaccactccactccgtccgctctcgcctgctctgcttgcttgctttctcttctctcccccgctccagcggatggcggaggcggcgcccgcagcagccggcggcggcatcggggacatcctcgccaccgccgaacgggacttcctcgtccgcaactccggcgagcaggtgaagatcagcagcatcgaggcgagccctgtggccatctacttctcggcctcatggtgcccgccatgcaggaggttcacacccaagcttattgaagtgtacaaagaactggcctcacagggcaagagcttcgaggtcgtctttgcttcggctgatcagaatgaggaagcattcaatgaatactttgcaaagatgccatggttggctgtccctttttctgacaccgaaggccgtgcggcccttgatggccggttcaaggtctctggtatcccacaccttgtcatccttgatgcaaaaactggtgatgtttgcactgaagatggtgttgaatttgtgagtgagtatggtgtggaggcttaccctttcacaccagataggatcaacgaactgaaggaacaggaaaaggcagaaaaggagaatcagactattcaaagcgtgcttggcacacctactcgagactatctcatttcaaacaagggagacaaggtacccatctctgagcttgaggggaagtatgttggtctgtgctttgtggtggatggctatggaccagtcattgaattcactaatttgcttgctaagatctatgagaaactcaaagaagtgggggagaaatttgaagttgtagctgtatccttggacagtgaagagtcagcatttaatgagagttttgcaaagatgccttggcttgcaattcctcaaggtgaccagaagtgtgagaagctggttcgttactttgagcttaggtctcttcctacactagttctgattggccctgacgggaagacactgaacagcaatgttgcggacataattgatgagcatggttttgaggcatgggagggcttcccctttagtgctgagaagctggaaattcttgctgagaaggcaaaggctaaagctgcatcacagaccttggagtcccttcttatcagtggtgaattggactttgtcattgggaaagatggtgcaaaggttcctgtatcagaacttgttgggaagactgtccttctttacttctcagcaaaatggtgtggaccatgccgtgctttcctgcccacacttgtcaaggaatacaacaagatcaaagagaagaacagtgattttgagatcgtcttcatttccagcgacagggatcagagctcattcgatgattttttctctcaaatgccgtggcttgctgtacccttggaagatgaaaggaaggcatccctgaagaagaccttcaaaatccgcgggatcccttcacttgtcgccatcggtcctactgggcagacagtcagcagggatgcaaaagcccagctgatgatccatggtgccgatgctttcccattcaccgaggagaggcttgaggagctgcagaagaagctggatgagatggcgaaggggtggcctcagaagctgaagcatgagctgcatgacgagcacgaacttgtcctgctgcgtcgtggtacgtatggctgcgatgcgtgtgaagagatgggcagcacatggtcctacaggtgtgatgagtgtgacttcgatctgcaccccaagtgcgcattggaggaggaaaagaagggcgaagaggaggaaggcaagtccactgaggaagcccctgctgggtatgtgtgcgagggaggtgtgtgcaggaaggcctagagttgtgttctactaagttgcctttgccagtttctggtgctatctgaatgttgtgagggggtgacaataatcgtgagatggttgtgcttggagctgaggcttgtgggctgttgatgtttgtgtgttaataataaatagtaggtgcaccctgaactcttaggagcatatatgtatgcagaactatgtgagtattgtgtcagatcaaagtaatggttttgctgcaaacccaaccnncccaacacctcacaacacaaccagaaacaacannaaaacncaagggcggccggcctaaaagatcacaacttacttacccgtgcttgcgacgtcttaactcccctaattgtgtccgctaaaattccaatcccctggcccgccgtttaaccacttcctgactgggaaaaaccctgggtttcccacattaaatccgcttggaagaagattcccctttctccccgtgggggtataaaccaaaaaggccggaaagaatggccttctccaaactccgccccccccc

SEQ ID NO: 838 - DNA, 656 bp, Saccharum officinarum
  misc_feature (138)..(138): n is a, c, g, or t
gaaagtgccaaccaaagttatgccaccaatgaataagcaaatggacccgttgaaccagataaggttcatgaaagaattccagaaaccatccacccagttggacatgacgcttgagatgatgtctgatcccatgatganaacacttgacaaagatgaggcggaggaggaaacagaagagcttacaaaccaggtccttgacgagattggcgtcgacgtggcttctcagctttcttcggctcctaaagggcgcatcggagcaactaacaagaaagtcgataacagccaagcacgtaatgctgcggctcctgcaaggaacgtggcggcaccgcccgaatcctctgctgaagttgacgatctggagaggcgactggcatctctgcgccgtatctgagtctgagccgctgaagaaagaacttggccctgttcggcaggctgttttttagcttataagccggctgtggctgatttgctgtgagagaaaaacactgttccacggctgataagccgtgttgataagctcagccgaacagggggcttgtttgtagtgtactagtagctattcatctatatatgtaaagttgtttatatgtgtaaggaaacagcaaactgcacatgatacggtttaataacctacctaatggtttatttatatcgag

SEQ ID NO: 839 - DNA, 1102 bp, Saccharum officinarum
cgacgaccgaaggaaggggaaagaggaggaggagtgcagagcaacgacagcacgtcgaggcgagagggagtagagcaaattgaagcaggtttcgtgttgattcggaggctttcgcttctgtttccggtggagatttgaggtctgcggcgacgatggcacctgcgaaatccggggagaaggcgaccagcttcgccatggcctgcagcctgctcagccgctacgtcaggcagagcagcaccgccgccggcgatcttggcctcgccatcagagctgaagccgatgcaaagaggacgtcggcagacacggaaaaggtggagacggctaaggagaccatggatctcttcccccagaacgctgggttcggctctgaggccgccatgaaagaagcccctgatgcgagggagccagagaagcaccagctgactatcttctatggtgggaaggtccttgtgttcgatgacttccctgctgagaaggcaaaagacctgatgcaaatggccagcaagggttcatctgtagcccagaaccctggcttgctgccaccccccacagttgcaaccgttactgacagcaccaagatcgcagcagcgccagccgcaccaattgccgtggtcaacgcccagaagagtgcggcagatataccccaggctcccaaggcatctcttcgccggttccttgagaagagaaaggatcgccttactgcgaaagcaccataccmaggttccccttcagatgctacacctgtgaagaaggagatggcggagggtcagccatggctcgggctgggacctcagatcgccaatcctgatctgagcctgtgcaaggaggggagccaatgatcgacaatccagcatcaccatcttcaaaaccgcgatactcctgcgaccagagtaaaggatcatagagagacttaacagtcatgtgccaaagtgttctgttttgggcctatcattccgtgttcttcgcgtggatacataggtkgtacgaatgtaaaggacgtagctaatgatggacttgacttgagtaaggattaccggtgctggggcaggtctgtggtggcctgacccaaatggccatkktaraaagatggaactgtaatgta

SEQ ID NO: 840 - DNA, 1214 bp, Saccharum officinarum
cccctcctccacgccagccatggacgaggatttcgagatgccgcccgccggcgccgacgagatgatgggcgacgacgagatgggcgacttcggcggcgacgagggcccggtgttgaaggtgggcgaggagaaggaggtcggcaagcagggcctcaagaagaagctgctcaargagggcgagggctgggagacgcccgaggtcggcgacgaggttgaagtgcattacacgggcacactccttgatggaacaaagtttgactcaagccgtgatcgcggagatcccttcaagttcaagcttggacaaggtcaagtgataaagggttgggatcaaggcatcaagaccatgaagaaaggagaaaatgctgtttttaccattcctccagagctggcttatggagcatctggttcacctccaactattccacccaatgcaaccctgcagtttgatgttgagctgctttcatggaccagtgtcaaagatatttgcaaagatggcggcatattcaagaagatccttaaagagggggagaaatgggagaacccaaaggatcctgatgaagtacttgtgaaatatgaggcccgtctcgaagatggtactgttgtatccaagtctgagggggttgagttcactgtaaaagatgggtacttttgtcctgccctggccaaagctgtcaagaccatgaaaaaggcagagaaggtgctccttacagtaaagccacaatatggatttggtgagaaaggtagaccagcagctggagaggaaggtgatgtgccaccaaatgccactctggtcattgaccttgagttggtttcatggaagactgtcacagagattggtgatgataagaaaatccttaagaaggttctcaaggagggcgaaggttatgagcgtcccaatgagggtgccgttgttgaagtcaaaattactggaaagcttcaggatggcacagtgtttacgaagaaggggcatgacgaagagccatttaaattcaagaccgatgaagaggaagttattgatggtcttgatcgtgctgtattgaacatgaagaagggtgaggttgctcttgtcacgattcctcctgaatatgcatttggttcaactgagtccaagcaggatcttgctgttgttccacctaacagcacagtggtctatgaagttgagcttgtttcatttgtgaaggacaaggagtcgtgggacttaaacaatgaagaga

SEQ ID NO: 841 - DNA, 1215 bp, Saccharum officinarum
aaccaaagccgagccgagcgcccgagccctgctccgacccgaccccaccgcgtcttctcctcctcggcttgacccctccaccgcctccatggggtcgtckgaggccgacgaggaccagctccttaagagcttcctcgcggaggtcagcgaggccgagcgggacaacgaagtgctcaggatacttggttgcttcaagttaaaccccttcgagcatcttaagttgtcttttgattcatcaccagatgaggtgaaaaagcaatataggaagttgtcattgttggtccatcctgataaatgcaagcatcctcaagcacaagaagcttttgcagctctggcaaaagcacaacagctcctgcttgatccacaagaaagaggctacattcttgaccaagttactgctgcaaaagaagaattgagggcaaagcggaaaaaggagctgaagaaagacagtgcgtccaagataaaatctctcgtagatgagggaaaatatgaagagcagtttgaacgatcagatgaatttcagaagcagttaataattaaagtacgtgaaattttgacggagaaagaatggcgtcggagaaaaatgcaaatgaggatatcagaggaagaaggaagacttaagaaagatgaggaagaaacaaaagagatgtggaagaggaagagagagcatgaagagaagtgggaggagaccagagaccaacgggtctccagctggagggatttcatgaagacaggaaagaagggacggaaaggtgaaatcaaacccccaaaattaaagactgaagatccgaacaaatcttatgtgcaaaggccagtaaagcgcaattgagaggaatggtattagtgtcagcaatcaaagaacatctggtaacgatctttcacgtcaccagattcaagctcagcaatcaaagaacatctggtagcgatcttacgtatcaccagattcaagctgctacccttcaatgttgcactggccctcaagatggtaaggttcaattatgcccgctgggctctagtgtagtcagtgaacagaacagattttacccgtattgctacccagagtgatttgggttgatgtactcgtcagtttgaagattttactggaaagaagtacaaaaatttccgttggaaaagaacctattgaagggaatgttgacagggtcgtctctttagtgttttatgtaagtaatgctgatatatgtacaatcgttcgtc

SEQ ID NO: 842 - DNA, 1334 bp, Saccharum officinarum
  misc_feature (1211)..(1211): n is a, c, g, or t
cgtcaagtcgtcgtgctcgtcttcgtctacctcccgactggaatagagaataccccattccccaaatccccaaccccggccggtcaaattagggtttcctgcttgcttcacaggcccgtccagtttgcggaatcagtgggtggcgcttgcgatggagtccctgttcggcttctgggacgcgcaatcgcagcggaggaggacgggcggcagcggcggcggcttcgaatcgctcaagcgtctgggtcacatctcccctgctgtgcagtcgcacctcaaacacgtgtacctcaccctatgctccgcgctggccttctctgcgctcggcgcttacctccacatcctcctcaacgtcggaggcaccctcacgaccctcggatgcctggccgccatcgcctacctcatctccctgcccgcctcacaggaccaggagaggaaccgcttcgccctgctcatggctgccgcgctccttcaaggcgcctccgttggcccgctcgtcgaccttgttattgacttcgatccgaggattctcgtgacggcgttcgtcggaaccgcaattgcttttggatgcttctctggcgctgccatcattgccaagcgcagggagtacctgtacctcggtggtctgctttcatctggcctctcaattcttctctggctgcagtttgctacttcaatctttggccacaccagcaccaccttcatgtttgagctctactttggcctcctggttttcctgggatatatggtgtttgacacccaggagattatcgagagggcgcacggtggggacatggactacatcaagcacgcgctgactctcttcaccgactttgttgccgttcttgttcggatccttgtcatcatgatgaagaatgcgcaggagaaatccgaagacgagaagaagaggaagaagcgctagctgctgaatgaattgggggacaccacaactccaactatcctatcttgttcctatgagaaaactcttgaaactatgttgttggggtctcccctttcctcctgagtctaccaaactcttgaaactataggttgttgggggtctcccctagtccccttccttcctgagtttacctaactattactactagtaccatgtatgtacatcgtactaaagaccagaagaagctttgagcatgctgttgttacctgaatgtaccgatgactgttgggaatgagtatttggtttggctacncccaacccaaccacacaaacattcgcaaccccgcgaggctcgaaacgacccaccctccaaacccaatccgcccacacgacagacaagccaacgccccaaaaacgacaccgcaggtggcgccca

SEQ ID NO: 843 - DNA, 1792 bp, Saccharum officinarum
  misc_feature (1768)..(1768): n is a, c, g, or t
  misc_feature (1774)..(1774): n is a, c, g, or t
cgggcgaggaggtgatcgtgaagctggactggcgggagtcgatgccgcacccggacgagcgcgtggagtacgagctgtggaccaacagcaacgacgagtgcggcccccggtgcgacgagcagatggcgttcgtgcgcgggttccgcggccacgcgcagctcctggagcgcggcggctacgcgcgcttcacgccgcactacatcacctggtactgccccgaggcgttccggctgacgcagcagtgccggtcgcagtgcatcaaccacggcaggtactgcgcgccggacccggagggggactthggcgcgggctacgaggggaaagacgtggtggtggagaacctgaggcagctctgcgtgcaccgcgtcgccaacgacaccggccgaccctgggcgtggtgggactacgtcatggactacaagatccgctgctccatgaaggaaaagaagtacaccaagacctgcgctgaggacgtcgtcaccgcgctcggtttggatctcaagaaggtgctggagtgcatgggcgaccccgaggccgacgccgacaacgccgtcctgtccaaggagcaggaagaccagatcggtagcgggtcgcgaggcgacgtcaccatcctgccgaccctggtcatcaacaatgtccagtacagagggaaactggagcggacggcagtgctcaaggccgtgtgcgccggcttcaaggaggggacggagccccgcgtctgcctcagccatgacatcgagacgaacgagtgcctgcacaggaacggcgggtgctggcgcgacgaggccaccaacgtgaccgcctgccaggacacgtaccggggccgggtgtgcgagtgccccgtggtgaacggcgtccgctacgagggcgacggctacactgactgcaaacctattggtccgggcaggtgcgctctgaacaacggcgggtgctggtcggagacgagagggcaccagatcttctccgcctgcacggagaccgcgctgaccgggtgccggtgcccgtcggggttccatggcgatggccacaaatgtgaagacctggacgagtgcagggagaagctggcgtgcacatgcccgggctgccagtgcaagaacacgtggggcaactacgagtgcaagtgcaagggcaaccagctctacatccgcggcgaggacgtctgcatagctaacaacatgtcgaagctcggctggttcatcaccatcgcggccgtggcgtgcgtagtaggcattggggtcgccggctacgttttctacaagtacaggctcaggtcgtacatggactcggagatcatgtccatcatgtcccagtacatgccgctggacagccagaacaacgagaaccagcctctgcggcagcacgattcggaagctctgaggcactaaagggctggcctgacttccctgagaggctatgccttttgcttggagaacttggacggtaaaccttaggtttcctcctgcaaggagttgctgccgggcaccaagctgcacacatgatttcaacagataatctgctgcgatttcgatgatatttgcttcgcttttgtatagcgtagaaaagagaggatggtttgcacagagcacagagttgagctctagagagtatagacaggtaggcatttcggctctcatgtagtcctgtggatcaagagccgtgtaaagtacacacacagcatttagagaaggcatatacgagctgctatacatgtacattgtacagtagacaaaccgtacggacaatttgatactgccatattggtatgggngggatntcaccttatgattctggt

SEQ ID NO: 844 - DNA, 2406 bp, Saccharum officinarum
agcgccgagatggaggacgcctgcgccgcggccccgcgcttcgccgacgtgccggtgcgcctgctcgccagccgccgcgacctcgacggcctgggcctcgacgccgacgcgctccgcctgccggcgcacctgttcggcgtcttcgatggccatggcggcgccgaggtggcgaactactgccgggagaggctccaggtgctgttgcggcaggacctgaggctactcggcaaggatttgggggagacagcagaggtggacatgaaggagcactgggacgagctgttcaccaggtgtttccagaggctagaagacgaggtgtcggggcaggcgagcaggctcgtcgatggagtccaggagtcacggccggtggctgccgagaacgtgggctcgactgcggttgtcgccgtcgtgtgctcgtcccatgcggtggtcgccaactgcggggattcgcgtgccgtactctgccgtggaaaagagcccgtaragctgtcgattgatcacaagcctgacaggaaggatgagcgggcgaggattgaggccctgggaggcaaggtcatccaatggaacggctaccgggtctccggtatacttgctatgtcgagatcgattggtatgtatattggttcctcarctaratcttggtagaattacttttttaagtgggatggaaattacagttgtagcaacatgaaaatgcttatgctgttgctgcatgttgtaaagtatcttagtttggtgtaataggactttgtggaagttctgagatcaaatctaagcagccagttgctgtaggaatcagtttttttgtggtattattattaattttttttgaaggcaaaactgtgggggagttccccacagcactcattttataaaatttaaatagtacagaacatacttacaaccagaattaactatatgcatctaatcaaaagcaaaaggctaatcttagatcctccttgaaacgaaccgactgaagaatacattggtttataattgctctatatgatctagagaattatcttcaatctaatggaataaggtttcatattgacctaggcaatttttccctagaagtcattttgttgaaagactctgtactatactctgtagcatggtgatttcgctagatgccatgcttccatttaggaagatagctgtttttatctgccctcgtttacaattaccatgttgtagctgttctatatattaaaaaaagtcctttatcagtgatttggtttaaactgcttgtttctatccgagatagcaagcatgatagacttaaaacactactgaaatcatgttctgggatttgactgtctggatattggctctaatcctatcagtgaagtggtaaaatgagctttaagtatatttctatggtatagaacacagaatgcagatgtgattaggaaatgaagttctccgcagtagaaaagccatctttaatcgacacgacaaaggtacctcatgtcatgattccagcaagtggcacttgcagcttggaccatggctaaccatcaatggatcttgtttggaaatgttaacattcattgccatcttaaaatcagatgcaccattgtgctaaactcttggacaatattgttcctccaatttcaaaagaaaatttagttgaaccaacaagttcagctgacttctctgtgggttggatagcatttgtccaattttcgtcaccttttttctaacttaaacttggaaacacttgttgcaggggaccggtatttgaaaccattcgtcattccaaaaccagaagttacagtctttcctagggcgaaagatgacgactgcctcattcttgcaagtgatggactgtgggatgtagtgacaaatgaagaggcatgcaaagttgcgcgtcggcaaatccaaatgtggcacaagaacaatagtgtcacatcatcattgtgtaatgggagtgatgaatccactgatcctgctgcacaagccgctgctgattatcttatgaggctcgcactgaagaagggtactgaggacaatatcactgtaattgtggttgacttgaaacctcgaaagaagctcaagagcaacccataacattgagctggatccatcagagtagagctgaccatgatatgtccaaagacttatactgctagttggtcgtccgcatgagacttgacccacagttttttttcgttgggcctctagaattgtacatgtatatgctagatgcattttccatagagggttatgatgcttaaccccactctggtttctggtggtttaaatattctccaatcggcttctaccttgagccctggcacttggtataatccccaatgctgtatgatagtcgaacttgtaaagagccaagcggctgagacggttactaaaattaacatattgttaccttaatgattcaaggcc

SEQ ID NO: 845 - DNA, 985 bp, Saccharum officinarum
agctgagggagagcaagaaggactacgacgtgcccaccgccatctcgctgatgaagcagatgtccagcgccaagttcgttgagtcggcggaggcgcacttccgcatgaacctcgaccccaagtacaatgaccagcagcttcgggccacggtgaatttgcccaagggaacaggccagtcggtgaagatcgcagttctcacacaaggtgagaagatagatgaagctagagctgcaggagctgatatcrtaggtggagaagacttgattgaacaaataaaagggggatttatggagtttgacaaattgattgcatcacctgatatgatgcccaaggttgccggcttgggtaagattctaggaccaagagggctgatgcctaaccccaaagctggcactgtttctccaaacattactcaggctatcgaagagttcaagaaagggaaggttgaatacagagttgataaatcaggaattgtccatattccctttggcaaggttgactttccagaggaagatctcattgcaaacttcatggctgttgttcgctctgttgagaggaacaagccatctggtgctaaggggatatactggaaaacggcgtacttgtgctcatccatgggaccttctatcaagctaaacataaaagaaatgcttgactatggtttggactcatctgactagatgtgaccacaggcaccagttaagtcagattaactatctgccccttgcgacaaatgagcagagacatggttgtggggaatggcaaggaggtgcttaggtacagttttttcagttttacgggcacccatcatcagagcagctaaagtatgcccagatcgacaaagaggtggtcttgttggtcatgtatttatgagcaaattatgcatggtttcatagatgtctgtctctgagacgtttgttgtaatgtttcatattctgtcaatagtcatccttgagcttaagccagcaatttattttcacctgtc

SEQ ID NO: 846 - DNA, 706 bp, Saccharum officinarum
caaagcagcctcccggtctagctagggtttcgtctccgcggcttgctctgatcctctcccggcacgcgagggcgcagcgttgatggcggcggcaccggcaccggcggacgcgaaggcggaggccgccaagatggacctcctcgaggacgacgacgagttcgaagagttcgagatcgaccaagaatgggatgacaargaagrmggcaatgaagccgtccagcagtgggaggatgattgggatgacgatgacgtgaatgatgatttctcgctgcagctgaggaaagagttggagggaagcaacgcccagaagagctgaagtattatttctctagtttataaatgatctttatatgccagctagtttcggaaccgtgatgtgctttggatgggttggtatggttgtgcagctctatgtgtgaacggcagaaagtttacggacatcagtcggcaatttggcagcactgtacctgttccggtggaaataatcccagttgtcggtaagacaggtctttagcggaaacagtagaaacccatattgcttgtcttaagcggtagccctttaaattttaattcccccctcatcatattatccttcttaatttatccatgatcatttaattcaataactagaatgcttcgcccattttcgtctactcccataaccaattcagggggggccgttttaaaggacccaaccttctttccc

SEQ ID NO: 847 - DNA, 1127 bp, Saccharum officinarum
cggctcactgacactacccgttgggctcggctcgcgcggcgccgtccttccccactctcccctcctcccacacgcacgaacgcagcacgcgccgcacccgcacccccacccgcggctcccccgcgaccaaatctgcggcgtggagtgagcacactgagggcggtctactcttcctcctccccgttcgcgagcggttcgtgctccgrgcgatmcggcagccatgaacatcttcaagaagaaggtcgaccccaaagaggctctcaggaccagcaaacgtgaaatggcggtcgccacgcggggagttgagcgagagattggttccctgcaaatggaggagaaaaagctggtcgcagagataaaaaagactgccaagactggaaatgaggccgcaaccaaaatattagctcggcaacttgtcaggctgaggcaacaaatcctcaatttgcaaggcacacgggcacagattcgtggagtagctactcacacacaggcaatgtatgccggcacttcaatctctgctggaatgaaaggtgcaagcaaagctatggcagcaatgaataagcaaatggaaccggtgaaacagataaaggtcatgaaagaattccagaaacaatcaacacagttggacatgacgcttgagatgatgtctgatgccattgatgaaacacttgacaaagatgaggcggaggaggaaacagaagagcttacaaaccaggtccttgacgagattggcgtcgacgtggcttctcagctttcttcggctcctaaagggcgcatcggagcaactaacaagaaagtcgataacagccaagcacgtaatgctgcggctcctgcaaggaacgtggcggcaccgcccgaatcctctgctgaagttgacgatctggagaggcgactggcatctctgcgccgtatctgagtctgagccgctgaagaaagaacttgtttgtagtgtactagtagctattcatctatatatgtaaagttgtttatatgtgtaaggaaacagcaaactgcacacgatacggtttaataacctaactaatggtttactagtatagtgcccgccctaacgctataataatactagtaacagctccataaacactagttctagatccccatcgcac

SEQ ID NO: 848 - DNA, 1788 bp, Saccharum officinarum
tcactcccaagcttattgaagtgtacaaagaactggcctcacagggcaagagcttcgaggtcgtctttgcttcggctgatcagagcgaggaagcattcaatgagtactttgcaaagatgccgtggttggctgtccctttttctgacacggaaggccgtgcggcccttgatggccggttcaaggtctctggtatcccacacctcgtcatccttgatgcaaaaactggtgaagtttacactgaagagggtgttgaatttgtgagtgagtatggcatggaggcttaccctttcacaccagataggatcaacgaactgaaggaacaggaaaaggcagaaaaggagaatcagactattcaaagcgtgcttggcacacctactcgagactatctcatttcaaacaagggagacaaggtacccatctctgagcttgaggggaagtatgttggtttgtgctttgtggtggatggctatggaccagtcactgaattcactgatttgcttgctaagatctatgagaaactcaaagaagtgggggagaaatttgaagttgtagctgtatccttggacagtgaagagtcaacatttaatgagaattttgcaaagatgccttggcttgcaattcctcaaggtgaccagaagtgtgagaagctggttcgttactttgagcttaggtctcttcctacactagttctgattggccctgatgggaagacactgaacagcaatgttgcggacataattgatgaccatggttttgaggcatgggagggcttccccttcagtgctgagaagctggaaattcttgctgagaaggcaaaggctaaagctgcatcacagaccttggagtcccttctaatcagtggtgatttggactttgtcattgggaaagatggtgcaaaggttcctgtatcagaacttgttgggaagactgtccttctttacttctcagcaaaatggtgtggaccatgccgtgccttcctgcccacgcttgtcaaggaatacaacacgatcaaagagaagaacagtgattttgagatcgtcttcatctccagcgacaggaatcagagctcattcgatgattttttctctgaaatgccatggcttgctctacccttggaagatgaaaggaagacatccttgaagaagaccttcaaaatccgcgggatcccttcacttgtcgccatcggtcctactgggcatacagtcagcagggacgcaaaggcccagctgatgatccatggtgccgatgctttcccattcaccgaggagaggcttgaggagctgcagaagaagctggatgagatggcgaaggggtggcctcaraagctgaagcatgagctgcatgacgagcacgaacttgtcctgctgcgtcgtggtacgtatggctgcgatgcgtgtgaaragatgggcagcacatggtcctacaggtgcgatgagtgtgacttcgatctgcaccccaagtgcgctttgggggaggaaaagaagggcgaagaggaggaaggcaagtcaactgaggaagcccctgctgggtatgtgtgcragggaggtgtgtgcaggaaggcctaragttgtgttctactaagttgcctttgccagtttccggtgctatytgaatgttgtgagggggtgacaataatcgtgaratggttgtgcttggagctgaggtttgtgggctgttgatgtttgtgtgttaataataaatagtaggtgcaccctgaactyttaggagcatatatgtatgcagaactatgtgagtattttatcagatcaaagtattggttttgctgca

SEQ ID NO: 849 - DNA, 595 bp, Saccharum officinarum
  misc_feature (593)..(595): n is a, c, g, or t
caaagcagcctcccggtctagctagggtttcgtctccgcggcttgctctgatcctctcccggcacgcgagggcgcagcgttgatggcggcggcaccggcaccggcggacgcgaaggcggaggccgccaagatggacctcctcgaggacgacgacgagttcgaagagttcgagatcgaccaagaatgggatgacaargaagrmggcaatgaagccgtccagcagtgggaggatgattgggatgacgatgacgtgaatgatgatttctcattgcagctgaggaaagagctggagggaaataacgcccagaagagctgaagtactatttctctagtttatagatgataaatgattgttatccagctactttcggaaccgtggtgtgcttagttgggtatatcctactataaaagggtgagttttttttagagtatctccctgcgtaataaccgttggatctggacttcgtgttatatgagtcctccgtcatacgtgatcttacatcttataagatgtaaacatgtggaactcaatctcatgtaagactcaaactcacgtacgacacgtaattaagccctgccgacttccagatttnnn

SEQ ID NO: 850 - DNA, 1886 bp, Helianthus annuus
actttcaccagcacctaattctcactacccacaactcctaccgaataaccactgctcatttgagttacgtttctcttaaagcttcaatctttatctatcttttgctcatttcttgaagaatcttgaagtgggtattctgttttctcttctgggttatcttcaattcaaatctttttcctctgttttgctcatttcttcaagaatcttgaagtgggtattctgttttctcatctgggttatcttcaattcacatctttttcctctgttttactcatgtcttgaagaatcttgaactgggtatactgttttcttatctgggtcatcttcaaatcaaatctttttcctctgttttgctcatttcttcaagaatcttgaagtgggtctactgttttctcatctgggtatcttaattttatcctatcgacatgaaaacagctcttttgaggttctaagtgatggatattgaaggaagaaagcagaattctcatccaatcaagaaagaatcatggagggaagtgatgactttagcttatcaaagyttaggggttgtttatggtgatttaagcacmtcccctttgtatgtwtacaaaagtgcttttgcagaagacattcaacattcagagtccaatgaagaratatttggagttttatctttygtgttctggacattaactttaatyccacttytaaaatatgtgttcatagttcttagagctgatgataatggtgaaggrgggacttttgctttgtacacattgttaygtcgtcatgctcgcgtcagcactttgccaaatggycagcttgctgatgaagagctttatgagtacaraagagatgaaktcgggtcgggttctagagatatcgggktgagtttgaagtcaactttggagaaacataaaatcttgcagaaaggtttgcttgttttggctttrcttggtacttgtatggtcattggtgatggagttttaactccggcaatatccgttttctctgctgtttctgggctggagctttctatatcaagagaataccatcaatatgtagaagtcccgtttgcttgcatcatactagtgctcttgttttgcctccaacattacgggacccaccgtgtaggattcttgtttgcacctatcgtgataacgtggctcctgtgcatcagcaccatcggaatttacaacatttttcattggaacccgcaagtttttcaagcgttgtcgccttattacatgtacaagtttctaaagaaaacacgaacaggaggatggaagtcrttgggtgggatcttgctgtgtataataggctcagaggctatgtatgctgatcttggtcatttttcycagttgtccattaagatggcttttacctttgtggtttacccwtccttgatccttgcttatatgggccaagccgcgtatctgtcaaagcatcacattctcgaaaccgactaccgaatyggtttctacgtatccgtccccgaaaaaataagatggccggttctyggaattgcaatacttgcagcagttgttggaagccaagctatcatcaccgggacsttttcaattatcaaacagtgttcggcattgggttgtttcccgagggtcaaagtaatccacacktcgcctactaataagcacggtcaaatctacatccccgagattaactggactttgatgctcctatgcttagctgtcacagttggttttcgtgatctcaaacatataagcaatgtagcaggtttggcggttattacggttatgttggtgacaacctgcctaatgtcacttgtaatggttctatgctggcgaaaaagtgttttcttagctctcgggtttatgttcttcttttggctcatcgaaattatatacttctcagcatccttgatcaag

SEQ ID NO: 851 - DNA, 1953 bp, Helianthus annuus
ggccatcgcatctcttgtccaccagagtacaacatcaacttgcattccaccttcaatgattcattaattattcgaaccttctgaaaccctgcactttaaataacgcgtgttgagtccatcatttctgcaatctcgtctcaactcctcaacagtcgcarcctatcgtggcaaattctcattcaagcccttccaatatcstctttaagaaccccatactcacgatcaagstcaacacgtcgtcgtttcacctctaaaaamgtattttaatcatgtcgagaaagatgctgattgatggtgatgtgagtaatgttagtgatgaagatcagtatgattttgatttgtttgtcattggtgctggtagtggtggtgttagggcttctagattttcagctcaatatggagctaaggttgggatttgtgagctgccatttcatccagttagctcggaaaccgttggaggtgttggtggaacgtgtgtgattcgtgggtgtgttccgaagaagattctggtttatggagcaggctttgggcctgaaattcaggatgcacgggagtatggctggcaagtgaatgagaatgttgattttgattggaaamggttactgcacaagaagactgaggaaatagtgaggctaaatggagtatacaaacgcttactttcaaatgcgggagtcaaactttttgaaggggagggaagaattgtgggccccaatgaagtggaagtgatacagttggatggcaccaaactctcctactctgcaaaacacatactgatctcaaccggtagcagggcacatcgtcccgatattcctggacatgagctagctattacatctgatgaggctttgagcttggaagagttaccaaagcgtgttgttatacttgggggagggtatattgccgtggagttcgcttcaatttggcgtgggatgggttccaccgtgaatctatgtttcagaaaggaacttccattgagaggttttgacgatgaaatgagagcgttggttgcaagaaatctcgaaggaagaggcattattttgcacccacaaacaaatttgacaaagttggttaaaacagaggatggtattaaagttactacagatcatggtgaagagctaatggcagatgtcgtacttttcgccactggacgggtccctaatacaaagagattaaatttgcaagctgtgggtgttgaagttgacaaaataggagcagtgaaggttgatgagtattctcgaaccagtgtacctagcatttgggccataggtgatgttacaaaccggatgaatcttactcctgttgcgttgatggaaggatctatgtttgctaaaacagtcttcggtaacgaacctagcaagccagaccatagcaacgtaccttgtgccgttttctgcataccgcctctctccgttgttggactaagtgaagaacaggccatagagcacgccactggggacatattggtgtttacgtcaacatttaaaccaatgaagaacaccatctcaggacgacaagagaagacactcatgaagcttatcgttgatgccgacaccgataaagttatcggagcctcgatgtgtgggcccgatgcaccagaaatcatgcagggcattgctattgcaatcaaatgtggagcaaccaaggcacaattcgataacacggtcgggatacacccgtcagctgcagaggagtttgtcacaatgcggtcagctacaaggcgtattgcagttgctggtaaaccgtagaccaacctctaaacacgtgttttagtcggttcctcaaaactcgcgttgttagaaaacacatgtgtaacattaagttttgattcataagttgcaacaatgttaaattcatcatgtttgtttggtatgtactgtgtactatatagccttatgaaatggaaaacaataatgaacaatgattgtaactaattgattgggtattggaccaaaa

SEQ ID NO: 852 - DNA, 1990 bp, Helianthus annuus
cggggatctattccgtatcaatccaccaacaaatctcctaacaattcgcgtattttcaaccaatttcaaccaacaatggatgaagatttcgatattccagcagccgacgagatgaacgacgatttcatggacgatattgaagctccggtgactttaaaagtcggagaagagaaggagatcggaaatcaagggctgaagaagaagctgttgaaggaaggtgaaggttgggatactcctgagagtggtgatgaagttgaagttcattatacgggaactttggttgatggtacgaagtttgattctagyagggatagaggagagccgtttaagtttactcttggtcaagggcaagtgatcaagggatgggatctgggtatcaagaccatgaagaagggcgaaaacgcacttttcaccattcccgctgatctagcttacggtgaagccggttcgcccccgacaatccctcccaaagccactctccagtttgacgttgaattgctctcatgggttagcgtcaragacatttgcaaggatggtggtattttcaaaaagatcgtaaaggaaggcgagaagtgggagaaccctaaggacctcgatgaggttttagtgaattacgaggttcgacttgaggatgggactctagttgcaaaatccgacggcgtagagttcgcagtacaagatggccatttctgtcctgcgctgtctaaggctgtaaaaacaatgaagaaaggggaaaaagtcatccttacagtcaaaccagaatatggatttggggagaagggaaaaccggcttctggagacgaagctgcaatccccgcaaacgctacgctgcaaattacgctcgaacttttatcatggaaggtggtgtcgaatgttacggatgacaagaaagtcgtcaagaaaatcttgaaagaaggagaaggatacgaacgaccgaatgaaggagccgttgttcaagtgaaattgattggtaagctacaggatggtaccgtgttcatcaaaaaaggtcatgatgattccgagcctttcgagttcaaggcagatgaagagcaagtgattgatggattggatcgagctgttttgacaatgaagaaaggggaagtagctcttctgacagtcgcaccagaatatgccttcggttctaccggttccgagcaagaattagcggtggttccccctaatgctaccgttacatatgaaattgagcttgtctctttcgttaaggacaaagaatcatgggacatgaccacgacccaagagaagatcgaggctgccggcaaaaagaaagaagaaggaaacgcgttcttcaaagccggtaaatataagaaagcagtaaagcggtatgagaaggctgctaagtacatcgagtacgatactaattttgaagaagaggagaagaaacaagcaaaagcgttgaagattacttgcaaccttaataatgcagcatgtcaactgaaactcaaagagtacaaacaggctgaaaagctttgcaccaaggtattggaacttgagagtacgaatgtgaaggctttgtaccggagggctcaagcgtacataaacgtcgcggatctggatcttgcagagcttgatattaaaaaagcactcgagatcgacccaaataacaaggatgtgaaacttgaatacaaagtactgaaggagaagataaaagaatacaacaaaaaggatgctaaattttatggaaatatgtttgccaagatgactaaatcatcatccaataaagcaaaggaggcagaaccaatgagcatagacagcaaggcttagcatgaatatgaaagaaatgtgtgattgtagggggcataagagtgttatgggattttttgtggtcaagtgctcttattaagttatgctgtgtgttgacttgacaatggtgttctttttctctgtcacttagaattgaaactgttaatctaattgtattggttctgttaaaccatatagaggcaaatgtttgtttttcttgcaaaaaaag

SEQ ID NO: 853 - DNA, 905 bp, Helianthus annuus
gaagaaaaggggtttgtagcaaatcggaacgatgggagaagccaatacatcatcaatcgatgacgatttgcttcttaaaagcttctacgctgaagtcagcgaggttgagcgcgataatgaagtcgtcaggattctttcatgctttaagctaaacgcattcgagtatcttaatctaccattcgattcatctccagaagatgtgaaaaagcaatatcgtaagctatcattgttggttcatcctgacaaatgcaagcatccccaagcaaaggaagcattttctgccctagcaaaagctcaacaactattacttgatccacaagaaagagaatatcttgtaaaccaaattaacgcagcaagagaagaacttcgagcaaagaggaaaaaacaactgaagaaagacactgcatctaagctaaagtcactagtcgatgagggaaaatatgagcaagaatatgaaaaatcagatgaatttcaggctcagctaaagttgaaagttcgggaaatactaaccgaccaagaatggcgaaggaggaaaatgcagatgaggatttctgaggaggaaggtagattgaagaaagatgaggaagaatcgaaagagatgtggaaaagaaagcgtgaacatgaggagcagtgggaaggaacaagggaaaatagggtttctagctggagggactttatgaaagggggaaagaaggtgaagaaaggtgaacttcgaccaccaaaactgaagacagaagaccctaataagtcgtatgttcaaaggccagtgaagcgaggttaggtggccctacaattgccgaattttacttgaattgtgcaacttcacagttgatttagtggttgaatactgtaactttctattgttatctttagcgcagtataagagcattgtatatttgcatttt

SEQ ID NO: 854 - DNA, 1303 bp, Helianthus annuus
  misc_feature (1259)..(1259): n is a, c, g, or t
gcgggggcggcgtcaatacatacaaacaacaactactcaccacccccttattatttctatttccttaatccccattattgcttttgcgtcattttccccaaaattttcgcccaaaatttcttcatcatccgatccctataaaccccataatcctcatcrcaaactccaatygcctgctcgctcgttagggttttacatctcaatcacaattactgattgatttcarggtccaattcagwaaaaaaaaatcgaattttagggtttatatataattagataagatgagctttcaggatctggaagcgggtcgtccgttgaatacaaggcgggtcggatacaccaatggattcaagcaacaagatccgacccaagctattgcgtccgggatatttcagatcaatacggccgttaactcatttcaacggctggttaaaactcttggaacacctaaagatacccatgaactaagggaaaaactgcataagtcgagactacatattggccaactggttaaagatacttcggaaaaactcaagcaagcgagcgaaacagatcatcgtgcggaagttagtgtgagcaaaaagattacggatgctaaacttgcgaaagattttcaagcggctttgaaagagtttcagaaggcccagcgccttgcagctgaaagggagacggcttacactccttctgttcctcaagctgttcttccctcaagttatgctgccagtgaaatggatataggctcggacagaagtcaagaacagcgtgttcttcttatggaatctagaagggaggttttactgttggacaatgagatcgcgtttaacgaggctatcattgaagaaagagatcaagggattcaagaaatccaaaaccaaataggcgaggtaaacgagatttttaaggatcttgctgttttggttcatgagcaaggagctatgatcgatgatattggctccaacgttgagaattctcacgctgcgactgcacaggcgagatctcatcttgcgcaagcatcaaaaactcaaagagcaaactcttccatgacttgcttgcttttggtgatagtcgcgattgtgctttgcatcgtggtcataatcgttgcagtttgacttcataccaatgtatctacgggtcagaagcaatttaatatgctccttttgagcatcttgggttctacaaggattgttttcttctttctttcattgtgtgaaaatatacttgaaatttatatttgttaaaaggatgctttctgtgtgagnagcagcttctctttcttccctctcccttatttaaaaaaaaaaaa

SEQ ID NO: 855 - DNA, 1294 bp, Helianthus annuus
gagatggatattcagtggagcgagcaccccacggggcgatattcctccatcacaatttactacaaaaccatcgacagactctggcgatgagagtgaaacaaaggtcggtatccacaagattctatcctcaaaagccgaagcgtggatgggtaaaaaggggattacgtggccgtggagaggaaacgaaagagaacgagattcgaaaacgggtcggtttggtctgcattggttgcataacgatcaagaacatgattcgggtcaacaaacgagttcgtcgaaagtagaaagtcaaccgtgggaaaacatgaataggaatgaggctacggggtcttggtcttcgtttaatgttaatagtacgagcagtgcaagtagttgcagcagcacgaatagtagcgcgattaataaagtggatatggatactgatagcttggattatgaaatcttgtgggaagatttaacaattggagaacaaattgggcaaggttcatgtgggacggtataccatgcaatgtggtatggatcggatgttgctgtcaaggttttctcgaggcaagaatattcagaggacgtgatattatcgttcagacaagaggtatctctcatgaaacgacttcggcatccaaacattctactcttcatgggtgcagttacttcgcctcaacgcctatgcatcgtcacggagttccttccacggggaagtttgttccggttacttcaaagaaatacagctaaattagattggagacgtcgagttmatatggccatggatatagctcgaggcatgaactatcttcatcattgtcacccgcccatcatccatcgtgatttaaaatcttcraatcttcttgttgacaagaattggaatgtgaaggttggagattttggtctctcgcgtatcaagcatgaaacataccttacaacaaagacggggaagggaacgccgcaatggatggctcccgaggttcttcggaatgaacaggctgatgaaaagtctgacgtgtacagcttcggtgtggtactatgggaactcactaccgagaagatcccttgggatactcttaactcgatgcaggtaatcggagctgtagggttcatgaatcaacaactagatattccaaaagacgttgatccccaatgggcttcacttatcgaaagctgctgctgcagtgaaccacagtcccgaccaacgttccaagaaatactagataaacttaaagaattgcaaaaaaaattcaccttacaacttcaggcgtcacgtacagccaccaccgctgccagcaccgccacaaccact

SEQ ID NO: 856 - DNA, 763 bp, Helianthus annuus
gcccaattttcgcatttcccgatcaattcaatctccgatcacacacgttcctgatcatctagacctagggtttcatttcaatcggaatccttccttatttcggtgatgagttttcaagatatcgaagccggtcgcccgatcaattcgaggcgtggtgtcattagaaaacaggatcccacgcaagctgttgcttctggaatcttccagatcaatacggcagtttccacsttccagaggctagttaacaaccttggtactccaaaggatacccctgagcttcgagataagctgcacaaaactagactgcatattgggcaattggtgaaggatacttcagataaacttaaacaagctagtgaaactgatcatcatgctggtgttagtgccaycaaaaaratcacagatgctaaacttgcaaaagatttccaaacagttctacaagaatttcaraaggcacarcgcctttcmgctgaaagggaaacagcttatgcrccttttgttcctcartcttcwcttccttcacgtgatccmgcyagtgaagcagatgtaagctcagacagaagtcaagaacagcaagctcttcttgtggaatctaaaaggcaggaggttttgctgttggacaatgagatcgcgttcaatgaagcgatcatygaggaaagagatcagggaatacaagagatccagaaccaaatcggtgaggtcaatgagattttcaaagatcttgctgttttggttcatgaacaaggaactatgatcgatgata

SEQ ID NO: 857 - DNA, 757 bp, Helianthus annuus
attttccccaaaattttcgccttaaaattcttcatcatccgatccctataaaccccataatcctcatcgcaaactccaatcgcctgctccctcgttagggttttacatctcaatcacaattactgattgatttcagggttcaattcgtaaaaaaaatcgaattttagggtttatataattagataagatgagctttcaggatctggaagcgggtcgtccgttgaatacaaggcgggtcggatacaccaatggattcaagcaacaagatccgacccaagctattgcgtccgggatatttcagatcaatacggctgttaactcgtttcaacggctggttaaaactcttggaacacctaaagatacccatgaactaagggaaaaactgcataagtcaagactacatattggccaactggttaaagatacttcggaaaaactcaagcaagcgagcgaaacagatcatcgtgcggaagttagtgtgagtaaaaagattacggatgctaaacttgcgaaagattttcaagcrgctttgaaagagtttcagaaggcccagcgccttgcagctgaaagggagacggcttacactccttctgttcctcaagctgttcttccctcragttatgcagccagtgaaatggatataggctcggacagaagtcaagaacagcgtgttcttcttatggaatctagaaggcaggaggttttgctgttggacaatgagatcgcgtttaacgaggctattattgaagaaagagat

SEQ ID NO: 858 - DNA, 1007 bp, Helianthus annuus
ggcggggagcattatcgtcttgtcttcctgaagatgatgagcaagcatccacttcaagctctgctgttcactcgcctcagctaaaatttgcagcacttttgctcgtcttgctttctatctgcactccatccttctcagagatcatcttcgaggagcgatttgacgatgggtggcagagccggtgggtgaaatctgattggaaaaaaagtgaaggaaaggccggttccttcaagcacacagcgggttcgtggtctgctgatccagatgataaaggtattcagacgagtactgatgccagacattatgccatctctgcaaagatcccagaattcagcaacaaaaatagaacactagtcttacagtactcgatcaagtttgagcaggatatcgagtgtggtggtggttatatcaagcttatgtcgggatatgtcaaccaaaaaaagtttggtggcgacactccttacagtgtgatgtttggaccagatttatgtggaacacaaacaaagaagcttcatgtgatcctttcctaccaaggacaaaattatcctattaagaaggatttgcagtgcgaaactgacaaattaacgcatttctacacattcatacttcggcctgatgcaagctatagtgtgttaatagatggtagggaacgggattccgggagcatgtatactgattgggatatccttccaccccgaaaaatcaaagatgtaaatgctaaaaagcctgcagattgggaggagagagaatatattgacgacccgaatcaagtcaagccagagggctatgattcaattccaagagaaattcctgacccgaaagctaaacagcctgatacctgggatgaagatgaggatggggtatggagaccaccaaagataccaaatccagcatacaaagggccatggaaaccaaagaaaataaaaaatccaaattacaaggggaaatggaagatcccgtggattgataacccagaatttgaagatgatcctgacctatatgtgctc

SEQ ID NO: 859 - DNA, 2027 bp, Helianthus annuus
gggggctgccccgtaattaccccattcagaactctctagaactaccctcaatccctctatataaaccctctcaccctccattttcctgacgcattaatcacatcactcacatttgcgatactccccttgtttaattatttgtttgattcacaatggaggatgattttgacttttcagcagctggtgcgatgaacgatgaaatgatggatgaaacgccgtcgtatgatgctccgttgaaggttggagaagaaaaggagatcggtaatcaaggcttgaagaagaagcttcttaaggaaggtgaaggttgggacactcctgacaatggcgatgaggtcgaagttcattataccggaacattgcttgacggaacgcagtttgattcgagtcgtgatagggggactccgtttaagttcactctcggtcaaggccaagtgatcaagggatgggatcaaggaatcaaaacaatgaagaagggtgagaatgcacttttcaccattcctgctgagcttgcatacggcgagtccggttcgcctccaaccatccctccaaacgcaaccctccggttcgatgtgcaactgctatcctggctcagtgttaaggacatttgcaaagatggtggaatcttcaaraagattctaaacaaaggagagaagtgggaaaaccctaaagaccttgatgaagttttagtgaattacgaggttcgactcgaggatgggacgttggttgcaaaatcagatggagtagagttcactgttcaagatggacatttttgccctgcgctgtcgaaggctgtgaaaacaatgaagaaaggagaaaaggttttgcttacggttaaacctcaatatggatttggggagaaggggaaacaagctttgggtgwcgaagstgccattcctgcaaatgcgacactacaaattacattagagcttgtttcatggaagacggtttctgatgttacgaaagacagaaaggttatgaagaagattttaaaagaaggagaaggatacgaacgtcctaacgaaggagctgttgttcaggtgaaattgatcggtaagctgcaagatggcactgtattcattaacagaggttatgatgatgggaccgagctgtttgactttaagacagacgaagagcaagtaattgacgggctcgatagagctgttatgacgatgaagaaaggggaagtagctattctaacaatcgcaccagaatatgctttcggttctacagaatctaagcaggagttggcagtcgtccctccgaactccactgtgatttacgaaatcgagctcaattccttcattaaggagaaagaatcatgggatatgaacactcaagagaagatcgaggcagctggtaaaaagaaggaagaagggaactcgttgtttaaggctggtaaatatctcaaagcatcaaagcgatacgagaaggctgttaaatacatcgaatacgatactagttttgacgatgaggaaaagaagcaagctaaggcgttgaaggtgtcgtgcaacctcaacgacgcggcgtgtaaattgaagttgaaggagtacaaacaagcggagaagctctgcaccaaggtgttggaaagtgatagtgggaatgtgaaggccctgtacaggagggctcaagcctacattcatcttgctgatctggatctggcggaactcgacataaaaaaggcgcttgaaatcgaccctgataacagggatgtgaagctggagtataaggtgctgaaggagaagatgaaagaatacaacaagaaggatgctaaattttatggaaatatgtttgctaaacttggggtccttgattctaagaagacagcagcagctccaatggccatagacagcaaggcatgatgaacacatgaatacaaggaaggatgtttgcataagtgtcctttgtttgtttgttttgtgtttggtatatgatgttttgtttcttccttcttagttgtgaataataatgagatagtgaaacaacccgttacaactactttttcatttttacttcatgctttccttttt

SEQ ID NO: 860 - DNA, 2394 bp, Helianthus annuus
gactctctctctctctctctctctctctgcacaattctctttatgcaacacttgttctaaatatagcttcagattctgtatgtatcatccaatataacacgtaccctcttcaattgtatcgataccctttatcagttacacaacctttaagtcaaaccccatcactttgatccaaaaactttgataaatctcataaagttttgatctttattactggggtttcaccaaaaaacaatcttgatttgttttcctgatctgggtcagtttctattggtcaactttgaccaaaattgcaactatgaaagtgggaaaatcagggtttgtgatttgggtttgtttttggttgttgtgtggatcatgtttgggtagatttgtggttgagaagaacagtttgagggtgacgtcacctgatcatttgaaagatgtgtatgaatgtgcaattggtaattttggtgtgcctcagtatggaggaacattgactggtgttgttaagtacccgaaatcgaatcaaaaggcgtgtcaaagctttgattcgtcgttgaaatcggaaccggctggtggtttgccccttttcgtgcttcttgatcgcggcgattgttacttcacattaaaggcatggaacgcgcaaaaagccggagctgccgctattctcgttgcagacgacagacccgagccgttgatcacaatggacatgcccgaagcggagagcgcgcccgcagattacttgcaaaacatttccatcccttctgctctcatcagcaagtcactcggtgattcaataaagaaagcgttaaacaagggtgaaatggtaaatataaaactcgattggacggaagctcttcctcaccccgatgaacgtgtcgagtacgagttttggaccaacagcaatgacgagtgtgggaccaagtgcgatagtcaaatcaattttgtcaaagactttaaaggggcggctcaaatcctcgagaaaaaagggtacacgcagtttacaccgcattatatcacgtggtattgccctgaggcgttcacgttgagcaaacagtgcaaatcgcaatgtattaatcatggaagatattgtgctccggatcccgagcaagattttagtaaagggtatgatgggaaggatgtcgtggttcaaaatttacggcaggcttgcttttataaagtggcgaatgagaccgggaagccttggctttggtgggattatgtgacggatttttctatccggtgcccgatgaaggataagaagtacactaaagagtgtgcggatgaagttattaagtcacttggcattgatttgaagaaaatcgatgaatgtgttggtgacacagaagcagataccgataacgcagtccttaaggctgagcaagaaacacagataggcaaaggttcacgtggagatgtaacaatactgccgacgctcgtcataaacaacagacaatatagaggtaagcttgcaaaacaagcagttctgaaggccatttgctccggattcgaagagacaaccgagccagccgtatgtttgactgatgaaatacaaacaaacgagtgtttagacaacaatggcgggtgttggacggacaaagctgctaatgttacagcatgcagggatacttttcgagggagagtttgtgaatgcccggttgtgcagggtgtaaagtttgttggcgatgggtataaacactgtgaagcttctggagcactacggtgtgaagttaacaatggaggctgttggaaaggcagcaaactgggcaggacctactctgcttgtattgatgaccatacaaaaggttgcaagtgtccaccggggttcaaaggagatggagttaacagttgtgaagatgttgatgaatgcaaagagaagacagcgtgtcagtgttccgagtgtaaatgcaagaatacatggggtagttatgagtgtagctgccgtggtaatttgctctacatgcgagaacacgacacttgtataagtaaagatggtaaatcagaagtcagttggggattcgtgtgggtcattattctcggtctggcagctactggagccgcaggatattccttctacaagtacagggtccggacatacatggattccgagatccgggctatcatggcacagtacatgccgttggacaatcaggccgagattgaagttcacgggactcgtgggaatgtgtaacaagatacaaacrggtttagagacccacgaccgacctttctttaatttaayggtcgtgttttgtttgttcgacttatctatgtatatgttccaacgacggtcatgattttccaaggctgctcgagttagactaaagatmtttgtgattgaggttctttatttatgttagcatgtcataataaaaccattttaatctttgtgggtgatgctacaaatttagt

SEQ ID NO: 861 - DNA, 2225 bp, Helianthus annuus
gggggaaccttggagttgatttacgtgcagattaagcaactttgtgcatcatcgtcttgtgtatatatttagcttaaagcctgtatgtatcagcagtatcaccgattataagacgtacatacatacatactccccaatttcctaatttcagactgaaagtgagtaatgatgaaagtagggtttatagttttggtttggtttattatgttcatgtgtgggccgtgtttgggtagatttgtggtggaaaagaacagcttgagggtgtcatcacctgataatttgaaaggaacatatgaatgtgcaattgggaattttggtgtccctcaatatggtggaacattatctggttatgttgggtacccaaaatcgaaccagaaggcgtgtgaaacctttgattcatctttgaaatcggagcctgctggtggtcttcccctttttcttctacttgatcgtggcgattgtttctttacattaaaggcatggaatgcacaaaaaggtggtgctgcagccgttcttgttgtagacaacagacccgagccattgatcaccatggatatgcctgaagaagaaaacgtgcatgcagattacgtacagaacataacaatcccatctgctctcattagcatgtcactcggaaattcaataaagaaagctttaaacaagggcgatatggtaaatataaaactcgattggacagaagctctccctcaccctgatgagcgcgtagagtatgagttttggacaaatagtaatgacgagtgtgggaccaagtgtgacagccaaataaattttgtgaaaaattttaaaggggcggctcaaatacttgagaaaaaagggtacactcagtttacaccgcattatatcacttggtattgccctgaggtgttcacatttagcaaacagtgcaaatctcaatgtattaatcatggaagatattgtgctccggatcccgagcaagattttagtaaagggtacgatgggaaagatgtggtggttcaaaatttaaggcaggcctgcttttacaaggtggcgaatgaaaccgggaagccttggctttggtgggattatgtgactgatttttctatcaggtgccccatgaaagataaaaagtacactaaagagtgtgcagatgaagttattaagtcacttggtgttgatttgaagaagattgatgagtgtgttggtgacacagaagcagatgtcgataaccctgtactcaaggctgagcaagaagcacagataggcaagggttcacgtggggatgtaacaatactcccaactctggtcatcaataacagacaatataggggtaagcttgcaaaacaagctgtyctgaaggctatttgctcaggatttgaagagaccactgagccagccatatgtttgagtgatgaaatagaaacaaatgagtgtctagacaacaatggtgggtgctggatggacaaagctgccaatattacagcatgccgggatacatttcgagggagagtttgtgaatgcccgattgtgcaaggtgtaaagtttgttggtgatggctataaacactgtgaagcttcgggagcactacgctgtgaagttaataatggaggttgttggaaaggcacacagcagggcaggacctactctgcttgcattgacgaccatacgaaaggctgcaagtgtccaccggggttcaagggagacggagttaacagttgtgaagatgttgatgaatgcaaagagaagacggcgtgtcagtgtccggagtgcaaatgcaagaatacatggggtagttatgactgtagctgcagtggtagtttgctctacatgagagaacatgacacttgtattagtaaagatggtaaatcagaagtgagttggggattcgtgtgggtgatgatcctgggtctggcagttgctggagcagcaggatatgcattctacaagtacagggtccggacatacatggattccgagatccgggctatcatggcacartatatgcccttggacaaccaagcggagattgaagttcatgggccgactcggggtaacgtgtaaaagagggcaacaaagatagagaagggtttatttaacggtttttgttagtgttgtctatatgttttcatgaagttctcatctgtttatactacattttcttttgttytttttttttttttaagttataaaacaagtagtttacgtagttggttgggtgaaaatatttaaaataaaatggtttcttc

SEQ ID NO: 862 - DNA, 1870 bp, Helianthus annuus
accttttcaactttgcattctcctcctcaataatcgccactactcgtctctcgtgtcctttctcattcaaaccctacgattccgaagcaaatcaacctcttcttcatttcttcaccaacaactaaactaaaaacccttgatcacatacactacaggtggatttggtgttgtaataatgtcaaggaagatgctgaatgatggaggtgtgggaagtggtggtgaaagtgaagagaatcagtatgattttgatttgtttgtgattggtgctggcagtggtggtgttagggcttccagattttcagctcagtatggagctaaggttgggatttgcgagctaccatttcatccaatcagctcagagactataggaggtgttggaggaacgtgcgtgattcgtgggtgtgttcctaaaaagattttggtctatggagcgacttttgggcctgaaattcaggattcaagggagtatggatggaaagtcaacgagacggttgattttgattggaaaaagctactgcayaagaagacggatgaaatagtgaggctaaatgggatatacaaacgcttactttcaaacgcgggagtcaaactttttgaaggggagggaagaattgtggggccgaatgaagtggaagtcatacaattagatggcaccaaattgtcctactcagcaaagcatatactcatagcaactggtagcagggctcaacgtctagatatccctggacaggagttagctataacatctgatgaggctttgagcttggaggagttaccaaagcgcgttgttgtacttgggggagggtatattgcggttgagtttgcttcaatttggcgtgggatgggttccacagtgaatctatgttttagaaaggaacttcctttaaggggttttgatgatgaaatgagagctttagttgcaagaaatcttgaaggaagaggcataattttgcacccacagacaaatttgacacagctggtgaaaacagcggatggcattaaagttactacagatcatggtgaagaattaatggcagatgttgtacttttcgccactgggcggatcccaaatacaaagaggttaaatttacaagctgtaggtgttgaagttgacagtataggagcagtgaaggttgatgagtattctcgcactaatgtgcctagcatatgggccataggtgatgttacaaaccgtatgaatcttacacctgtcgccttgatggaaggaacaatgtttgctaaaaccgtctttggtaatgaacctagcaagcccgatcatagcaacatcccttgtgccgttttttgcataccacctctctctgttgttggactaagcgaagaacaggccatagagcaagctaaaggagacatattggtgtacacgtcaacatttaatcctatgaagaactccatctctggacgacaagagaagacactcatgaagcttatcgttagtgctgagaccgataaagttatcggtgcgtcgatgtgtgggcctgatgcggcagaaattatgcagggcattgctgttgcactcaaatgtggagcaacaaaggcacaattcgatagcacggtggggatacacccgtcgtctgctgaagagtttgttacaatgcgctcagtcacaaggcgtattgctgcagctggtaaaccgaagaccaacctctaaacctgaatcagttggttgttcctcacaactcacttccaaagagaaaacgggtacacattattttgattcaataacttaaacttttcatgtcactattgattattgttagcaaccgtgttaagtttctcgtatgtgagcttttgggttttttggaacgtgtcgataggaattggaatggaatagaaaaggcaatggattgag

SEQ ID NO: 863 - DNA, 1129 bp, Helianthus annuus
attatttctatttccttaatcctcattattgcttttgcgtcaattttccccaaaattttcgcccgaaaattcttcatcatccgatccctataaaccccataatcctcatcgtaaactccaatcgcctgctcgctcgctcgcttgctagggttttacatctcaatcacaattgctgattgatatcagggtccaattcgtaaaaaaaaattcgaattttagggtttatataattagataagatgagctttcaggatctggaagcgggtcgtccgttgaatacaaggcgggtcggatacaccaatggattcaagcaacaagatccgacccaagctattgcgtccgggatatttcagatcaatacggccgttaactcgtttcaacggctggttaaaactcttggaacacctaaagatacccatgaactaagggaaaaactgcataagtcaagactacatattggccaactggttaaagatacttcggaaaaactcaagcaagcgagcgaaacagatcatcatgcggaagttagtgtgagcaaaaagattacagacgctaaacttgcgaaagattttcaagcggctttgaaagagtttcagaaggcccaacgccttgcagctgaaaaggagacggcttacactccttctgttcctcaagctgttcttccctcaagttatgcagccagtgaaatggatataggctcggacagaagtcaagaacagcgtgttcttcttatggaatctagaargcaggaggttttgctgttggacaatgagatcgcgtttaacgaggctatcattgaagaaagagatcaagggattcaagaaatccagaaccaaataggcgaggtaaacgagatttttaaggatcttgctgttttggttcatgagcaaggagctatgatcgatgatatcggctccaacgttgagaattctcacgctgcgactgcacaggcgagatctcatctcgcgcaggcatcaaaaactcaaagagcaaactcttccatgacttgcttgcttttggtgatagtcgcgattgtgctttgcatcgtggtcataatcgttgcagtttgacttcayaccaatgtatstacgggtcagaagcaatttaatatgctccttttgagcatctt

SEQ ID NO: 864 - DNA, 1267 bp, Panicum virgatum
gtgctccttacagtaaagccacaatatggatttggtgagaagggtagaccagcagctggcgaggaaggcgctgtgccaccaaacgccactctgctcattgaccttgaattggtttcatggaagactgtcacagaaataggggatgataagaaaatacttaagaaagttctcaaggagggagaaggctatgagcgtcccaatgagggggcagttgttaaagtcaaaattacaggaaagcttcaggacggcacagtgtttacaaagaaggggcatgatgaagagccctttgaattcaagacagatgaagaggaagttattgctggtcttgaccttgctgtactgaacatgaagaagggcgaggttgctcttgtgacaattcctcctgaatatgcattcggttcagttgagtcaaagcaggaccttgctgtagttccgcctaacagcacagtgatctatgaagtcgagcttgtttcatttgtgaaggataaggagtcatgggacttaaacaatgaagagaagattgaggctgctggcaagaagaaagaagaagggaatgcactgttcaagttgggcaaatatgctagagcttcgaagcgttatgagaaggctgcaaagttcattgagtatgacagttcattcagtgaagatgagaagaagcaatccaagcaactgaagatcagctgcaacttgaacaatgctgcttgcaaactgaagctgaaggactacaagcaagctgagaagctttgcaccaaggtgctggaactagacagccaaaatgtcaaggccctgtacaggagggtccaagcctacatgcaacttgctgacctagaactagcagaggccgatatcaagaaggcgttggaaattgatcctgacaacagggatgtaaagttggaatacagggccctgaaggagaagatcaaggagtacaacaagaaggatgccaaattctacagcaacatgttcgctaagatgacaaagtaactggctggaagacagtaaaccttttggatcgggggatgtactgaagcagaggatcaacaaagcctgccgttcctgctgcccaaggacttccctagtttgacatttcgctttctggcctactgtttaatctactaaagcgcatggacgattgcatctgttagaacttagaacagagatgaggaacatttacttcgaggaccactattggctgattggctctgaatctgtttcatgattcttgttgagatctgagtgttcagtcttaaagaatttgatactccct

SEQ ID NO: 865 - DNA, 793 bp, Panicum virgatum
ttctagatctggcgacgggtacacgatcgctggccgcatcaagatcgatggcgcgaatgtgaagggctttggtcttccagctaagacatcaaacacaaaagtgatacttaatggtggtcagagggttacatttgccaggccagatggctactttgctttccacaatgtgccagctggaacccatttgattgaagtttcctcaatcggttacttcttttcccctgttcgagtagacatcagtgcaaggaatcctggctatattcaagcagcattgactgaaaccagaagagttttaaatgagcttgtgctggaacctctgaaggaggagcaatactatgaggtgagggagcctttctccgttatgtcacttctgaagagtcccatggggttgatggtcggttttatggtcctaatggtctttgtgatgcccaagatgatggagaacatagatcctgaggagatgaagcaagctcaagaacaaatgaggaacaaccctgtttcattctcaagcttgcttgccagagcgcagggctagaagtaaaatatggggataacgcaaatggatctgtctagtcgataatgtgttgaagcgctgcactaaaatgcttcmcmcctcgctcagaatgacttcctggggatgtggaaacttctttcccctatttttactgtattttaagctgtaatttatcwgtgatgtaaaaccttttgaaacctcaagctgaactagtcatgtagtacattgacatatacccggcaggttgagttattttgttgaaaatatacgttttttttg

SEQ ID NO: 866 - DNA, 876 bp, Panicum virgatum
gtgtttgggaatacattgaagacagtttttgaggcaattgtcttcttgttcttgatgcatccttttgacgttggtgatcgttgtgagattgaagatgttcagatggtcgttgaggaaatgaatatcatgacaacagtgtttctccgatatgataacctgaagatctattatccaaacagtgtacttgcaaccaaaccaattatgaatttttacagaagtcctgacatgggagaaggaattgacttctccattcatgttgcaacacctgtggagaaactggctctcatgaaggaacgtatactacgttacattgacaacaagaaggagcaatggtacccaggtgctatggttgtcctccgggacgttgatgacaccaacaagctgaaggtatcaatttggcttcggcacacactcaacttccaggacatgggcatgaggtggacgaggcgtgagctcgtgctccaggagatgatcagagtcttgaaggatctcgagatagagtaccgggtgctgccgctcgatgttaacgtgcggactgcgcctccgatccaatccacaaggatgcccacaacatggagttattcgtgagggcaatgtcaaggccggacctttaatccgtgaggttgcagatgagcaacttactacgttactccattgatctagtggtttccaactgcgagatctggtggcagctcgagtggtaactgcaggtgcttggtagcgactagagctagagaacagcagattagcttggtagagagctgatagtggtgcctgtgcaccctgtaattactgtactctgttgcgtggtcatacctttagatcttgtacatcggatgcaaaatggtggctgagagagtgataatgatggcaagt

SEQ ID NO: 867 - DNA, 537 bp, Panicum virgatum
ccacgcgtccggcgcctccgtgtctagctagggtttctgttccgcttcttctccccgcacgcgaagcagggcgcagcgttgatggcaacggcaccggcgccggcgcccgcggacccgaaggcggaggccgccaagatggacctcctggaggacgacgacgagttcgaggagttcgagatcgaccaagaatgggacgacaaggaagaaggcaatgaagctgtccagcagtgggaggatgactgggatgatgatgacgttaatgatgatttctcgmagcagctgaggaaagaactggagggaacccagaagagctgaagtgttttcttctgtagtataaatgttactyttgtatggccgttactttctgaacctctgtgtgcttcagacagttatgggtgtgcttctgggagcaccacctaatttgcggaatatttctacatgaaagtttatggtcgtgctatagtttccataatrtcggtgaatttctatatgaactgtatgataccagaaagtataggaacatgcggcaatttgccc

SEQ ID NO: 868 - DNA, 849 bp, Panicum virgatum
ctggaacggaacggcgtcttccctgtgaccctgtccgcgctgtgctaccgccggctaccgcgaccaccgtcccctccgctcccctccccggcgccccgcagcgagctcgtcagcctctcgccatggagacctgcccgtcggtgaagaacatcctcttgctggactccgagggaaagcgcgtcgccgtgaagtactacagcgatgactggcccacgctgtccgcgaagctggccttcgagaagtctgtcttcgcgaaaacccagaaagcgaatgctggaacggaagctgagattgtaatgtttgacggccaaattgtggtatataagttcatccaagacctacacttttttgttactggaggagaagaggagaatgagcttattttagcatcagttcttcagggtttctctgatgctgctgaccgacttctcaaaaacatggttgacaaaagaacagcactcgagaatttggacctgatcctattatgtcttgatgaaattgttgatggagggattgttcttgaaacagaagggagagagatagctgagaaggtgacaggtcatggattggagagtgcttcatccgctgagcagaccttactcaatgccctaacgcaagcaagagagcacttggcaaagtctctttatgtgatgttattgctttctatttgggggtgaagatggtgtatcatcctatagttatgtttaaggatataatacattcttttagcatttgagaatgaaattttttgaagtctattgatgtgtaaaatggcaacattctctggccgttcagttttgcaagccttcgaagtttgtgtaacgtgattgctccaattatggctggttc

SEQ ID NO: 869 - DNA, 420 bp, Panicum virgatum
ccggaccgtgtcgcgagtcccgatggcggagccggcgaagcccgaggtgacggaggaggccaagatggacctgctcgaggacgacgacgagttcgaggagttcgagatcgaccaagagtgggatgacaaggaagaaggcaacgaagcacttcagcaatgggaggatgactgggacgacgatgacgtcaacgatgacttctcgctgcagttgaggaaggagctggagagcaatgcgcccaagaagtagccaacatatgcagccttgtatcgagttggagagtggtgtgatggtgtccaaggactagttggcgtatgcagccttgtatccattattgtcagatagggactggtgtacggtgacgatggttgggacactgctactgttgttcggcgctcgtccttcttggcatggtcactgat

SEQ ID NO: 870 - DNA, 1289 bp, Panicum virgatum
agcgccgagatggaggacgcctgcgcggcggcgccgcggttcgcgcacgtgccggtgcgcctgctcgccagcctccgggacctcgacgggctgggactcgacgccgacgagctccggctgcccgcgcacctgttcggcgtcttcgacggccacggcggcgccgaggtggcgaactactgccgggaaaggctccaggtgctcttgagccaggagctgagccggctcggcaaggatttgggggaggtgggcgtggtggacatgaaggagcactgggacgagctgttcagcaaatgtttccagagagtagatgacgaggtgtcagggcgggtgagcaggctcgtcggcggtgtacaggagtccaggcaggttgccccggagaacgtgggctccacggcggttgtcgtggtcgtgtgctcatctcatttggtggttgcaaactgtggagattcacgggttgtgctctgccgagggaaggagccagtggcgttgtccattgatcacaagcctgacaggaaggatgagcgagcgagggtcgaggccctgggaggcaaggtcatccaatggaatggttaccgtgtgtccggtatacttgctatgtcgcgatcaataggggatcgatatttgaaaccgtttgtcatttcaaaaccagaagttacagtcattcctagggcgaaagatgacgactgtctcattcttgcaagtgatggactgtgggatgttgtatcaaatgaagaggcatgcaaagttgcacggcgacaaatccagttgtggcacaagaacaatggcgttacaacatcgttgtgtgacgaaggtgatgaatccactgatcctgctgcgcaatccgctgctgattatcttatgaggctcgcattgaagaagggaacagaggacaatgtcactgtcattgtggtcgacttgaagcctcgaaagaagcttaagaacaactcataacatgagctggattcatcgggagtagctgaccatgatatgtttaaaagagttcatactgctagttggtcgttcgcctgagacttgacccmcagtttttttttccgttgggcctcaagaattgtacatgtatatgctagatgcattgtccatytaggggagcatgatgttacccccacgttggattttggtggctaaaatgacctgaagtcattttttmccttgagccctggcacttagtataccccttgtaatgctgtatgatagtcgaacctgtaaagagccaagcggctgagacagtcactgaaattaacatactgttacctttatgattcaaggcc

SEQ ID NO: 871 - DNA, 693 bp, Panicum virgatum
agttagcataaccaaactgaatttgcactagtggttatttgttaactcgatagaaatcatcatcatcatcatcatcatcaatgaggccgctcgttgtgcttggcctggtcctcgtgctcgcagcaggggtcgcgctggacggcgtcgacggcgccggggagtgcgggagggcctccgctgaccgagtggcgctgcggctggcgccgtgcgtctcggcggccgacgacccgcagtcgacgccgacgagcagctgctgctcggccgtgcacaccatcgggcagagccccagctgcctctgcgccgtcatgctgtccggcaccgccagggccgccgggatcaagccggaggtcgccattaccatccccaagcgctgcaacatggccgatcgccccgtcggctacaagtgcggagactacacgctgccctgacgacctcgtgagtgaggccaccgcgctggtaattaataaagagatggacgccaaggaaaggctttgtgttggaataatcgagtctgcgcgaaccatgaacgtggacgaggggctctagccctatcacactggactgtgcttgtatcgtaattgtgttccacttcgtctaaaattaataagaatgaatgtgttgcttatcaagcccattacaggccatagccgrgggaaaatggtgttatgttgaagaggcccatgaaacccgaaa

SEQ ID NO: 872 - DNA, 1103 bp, Panicum virgatum
ggctccgcgttcacgccccccacgcgcccgcgcaccggcaaggccgccctgccgctcaagcgcgaccgcacgcggtcgaaaaggttcctcgagatacagaagctgagggagagcaagaaggagtacgacgtgcccaccgccatctcgctgatgaagcagatggccagcgcgaaatttaaagagtcggccgaggcgcacttccgyatgaacctcgaccccaagtacaacgaycagcagctccgcgccacggtgaatttgcccaagggaacaggccagycggtgaagattgcggtcctcacacaaggygagaagatagatgaagctagagctgcwggagctgatatagttggtggagatgaattgatcgaacaaataaaaggagggtttatggagtttgacaaattgattgcgtcacctgatatgatgcctaaggttgctggcttgggtaagattctaggaccaagaggactgatgcctaacccaaaagctggcactgtttctccgaacattactcaggctatagaagagttcaagaaggggaaagttgaatacagagttgacaaaacagggattgtccatattccattcggcaaggttgacttycctgaagaagatcttatcgctaacttcatggctgttgtgcgctctgttgagaggaacaagccatctggtgctaaggggatatactggaaaacggcrtacttgtgctcatccatgggaccttcaatcaagctaaacataaaagaaatgcttgactatggcacggaatcatcttagatgtcaccacaggcaccrgttaagtcatctggcatttgggaccacctccacaggttttaaccatccgtccctgctacagatgagcacagaaacaatggtcgrggggtaatygggtatgatggcaggtaggtgcttagatatataattttttttcagtttgacgagcacccatcatcagagcagttaaactatgcccagattgacaaagaggtgatctcgttgatcatgtatttawgagcaaatcatgcatggattcatagatgwctttctctgagatgtttgttgtaatcttcaatawtttgtyaatagtcatccttgatctcacc

SEQ ID NO: 873 - DNA, 1088 bp, Panicum virgatum
cccaccaaaccaagaccaagcaatccaaaggcaggctagggtttcctgtcctcccgtctgctgctgctgttgggraaaaattcgcctgattccccctttcaatcggaaggatctggccatggagtccctgttcggcgcctccaggaggacgacggctggcggcggcttcgactcgctcaagcgtctgggccacatctcccccgccgtgcagtcccacctcaagcacgtgtacctcaccctgtgctccgcgctggccttctccgcgctcggcgcctacctccacatcgccctcaacatcggcggcaccctcaccaccatcggatgcctggccgccatcgccttcctcatctccctccccgcgtcccagcatcaggagaggaaccgcttcgccttgctcatgtccgccgcgctcctrcaaggggcctccgtsggcccgctcstcgatctggtccttcacttggaccygaggatcctggtcacggcsttcgtcggsacsgcgattgctttyggatgcttctcggctgccgccatmatcgccaagcgcagggagtacctgtacctcggcggcttgctctcctctgccctctccattcttctctggctgcagtttgctgcttccatctttggccactactacttcacctttgagtagtcttcactttctctactaattccttcctagtacttcgtttggtagggcttcattcatcaaaagctattggagtattttgttgcagctctactttggcctcctggttttcctgggatacatggtgtatgacacccaagagatcatcgagagggcacaccatggggacatggactacatcaagcacgcactcactctcttcaccgactttgttgccgttcttgttcgggtccttgtcatcatgctgaaaaatgcccaggagaaatcccaagaggacaagaagaggaagaagcgctattgaatgraraaacaaaggcactcttttttttcctgaawttatytactctatmtagtagtgmtagtaaagacasaaagcttggatcagcttgtstagtkttyyggctggctactcggatcagcttgtstagtgttytkgckg

SEQ ID NO: 874 - DNA, 696 bp, Panicum virgatum
actagttttagatcgcgagcgatctagaactagtagctagcataatcaaactgagtttgcattagtggttaactcgagagaaaatcatcaacaatgacaatgaggccgctcgttgtgctcggtctggtccttgtggtcgcagcaggggtggcgctggacggcgccgacggcgccggggagtgcgggagggcctccgccgaccgggtggcgctgcggctggcgccgtgcatctcggcggccgacgacccgcagtcgacgccgacgagcagctgctgctcggccgtgcacgccatcgggcagagccccagctgcctctgcgccgtcatgctgtccggcaccgccagggccgccgggatcaagccggaggtcgccattaccatcccgaagcgctgcaacatggccgatcgccccgtcggctacaagtgcggagactacacgctgccctgacgacctcgtgagagaggccgccgcgctggtgattatgaaagagatggacgccaaggaaggctttgtgttggaataatcsagtccgcgcgaaccatgaacgtggacgaggggctccagccctatcacactgtgactgtgtgtgcttctcgtactagtactgtgtgttcaacttcgtctaaaattaataagaatggacgtgttgcttgtcaagcccattattggcccattaataaaaatggtgttgtgttg

SEQ ID NO: 875 - DNA, 1014 bp, Panicum virgatum
tcgtctccaccagccagccaagccagcaaccgcatcgaagcagccagcggcctagggtttccgcgccaaggagcgagcgacgaggcatgacgactgcggcgcgcccgacctgggctccggccaagggcggcaacgagcaggggggcacccgcatcttcgggccctcccagaagtactcctcccgcgacctcgccgcgcacacctccctcaagcccaggaaagagggccagcagacccaagaggagttacagaagaggaacctcagggaggaacttgaggatcgtgagcgcaagcactactcttccaaggataagtcctacgctgaagagagagaccggcggaaaagttcaagccagctgctattagaaggttcaaagagagatgccgaggataagatagttccacgagaaatcgatgcagatgactctgatgtggagcctaaaagtgacgacgaaagcgatgaagacgaagatgacgacgacgatgacacggaagcactaatggcagagcttgagaggattaagaaagaaagagctgaggagaagcttagaaaggagcgccaacaagcagaagaggaggccaagatgaaggaggctgaactgatgcggggaaaccctttgatcaatgtcaacaatcctggctccttcagcgtcaagagaaggtgggatgatgatgtggtattcaagaaccaggcacgtggagagaccaagactccaaaacggttcatcaatgacaccatcagaagtgatttccaccgcaaatttcttcagaggtacatgaagtgaggcttktgctgtgtatggttgaacatgyccctsscgtggtatgtsaggggccttgtttcggggctcatcatyttgtgataaaagatgtgtttgtgtatgagggagagaccattgtgctgtatgaaataacttgccctttaaagatgtttttgtttcaagtttgaaatgatacytaaaccctttcccagatggggaaagrtaaaggaagttagtgcactttgtttttttt

SEQ ID NO: 876 - DNA, 935 bp, Panicum virgatum
cttcctctaagaggttttgatgatgagatgagagaagttgttgcaaggaaccttgagggaaggggaatcaaattgcatcctgggacaaatctgtctgagttgagcaaaacggctgatggcataaaagttgtaactgataaaggagaggagcttattgcagatgttgttctatttgctacagggcgcacacccaactccgataggctgaacttgcaagctgcaggtgtcgaggttgaccagattggagccatcaaggttgacgaatattctcrtacatctgctcctagtgtatgggctgtaggtgatgtaacaaaccggatcaatctaacacctgtcgcattgatggaggctacttgcttttccaaaactgtgtttggtggccagcaagttaagcctgattacagagatgttccttgtgctgttttctccattccaccgctctctgtagtgggcctcagcgaacagcaggccttggaggaagccaagggtgatattcttgttttcacttcatcattcaacccaatgaagaacagcatatccaagcggcaggagaagactgtgatgaaactggtagttgatgctgaaactgatagagtacttggtgcgtccatgtgtggaccagatgcacctgaaattatccagggcattgctgttgcacttaaatgtggagccaccaaagcaagcttcgacagcacggtcggaattcacccttcggctgccgaagagtttgtgaccatgcggaccttgaccaggcgcgtgagcccgacgtccaagccaaagacgaatttgtaagcaacatcggtgttttggggactacacatgttgtttgtacgcagactgtttccattttggtgattttacgtcattcgaactggaacactatattataaaggaataagatttttgcgtaacagacatatttttttcggcctttt

SEQ ID NO: 877 - DNA, 1542 bp, Panicum virgatum
tagkawagtgskmsgwgctcgstcksstswscssgcgsctactgagggcgggggcgatgggccgcgccttcctccaccgcgcgctggtcctctcgtcgctgctcctcctcgcctccggcgagatcttcttcgaggagcgattcgatgatgggtgggagcaccgttgggtgaaatctgattggaaaargagccaaggacaagctggaacrttccggcacacagcgggaacctattctggagatcctgakgataaaggtatacaaacaactggggatgccaaacattttgctatatcggcaaaattctcagaatttagtaacaagaaccgaacattagtggtccagtactcgctaaaaatygagcaggatattgaatgtggcggtgcttacatcaaactyatgtctrgccatgtcaaccagaagaaatttggtggcgacacaccttacagcttcatgtttggrcctgatatatgtggggatcagaaaaagaagctccatctcatactttcgtaccaggggcaaaactaccctatcaagaaagatytaaaatgtgaaacagacaagttgacacatttttacacatttattctcagacccgatgccacttatagcatccttattgataaccgggagagagaatttgggagcatgtacactgactgggatatccttcctcctcgtaggatcaaagatgttgatgcaaaaaagccaaaagattgggatgacagggagtatattgaagatcctgatcaagttaagccagagggatatgactcaattcctaaagacatacctgatccaaaggacaaaaagcctgagtcatgggatgacgacgacgacggtatatggaagcctagaatgataccgaatccagaatacaagggaccatggaagcggaagaaaattaagaatcctaactacaaaggaaagtggaagaccccatggattgacaatccagagtttgaggatgacccrgacctataygttytgaaacctttgcagtatgtggggattgaagtctggcaggtcaaagccggttctgtttttgacaacattttgatttgtgatgatccggactatgcaagacatgttgtagacgaaacttttgctgcaaataaggaggctgaaaaggaggccttygaaggagctgaaaagaagaggaaggctagagaagaagaggaagcacggcgggcgcgggaggaaggggagagacgaaggcgagagagggatagggaccgtggcagggaycrttacagggatagatataagcgtcataggcactacgactaccatgacgagctatagatcttgcaccttcgaaatytgctgggcatcakttgttcrtctatggaaaggggccttcatgattgtgttaataagatgtgccactttgtggcaaagatatttgaagtccttggccgtactgttacagtcatggagacggagagcacacgctgaatttgtatgttgcacaacctgaatcagactgaaactgtgattccgtacagcttcaaactgtaactaaatttycaygttggccatg

SEQ ID NO: 878 - DNA, 1000 bp, Panicum virgatum
cccaccaaaccaagaccaagcaatccaaaggcaggctagggtttcctgtcctcccgtctgctgctgctgttgggraaaaattcgcctgattccccctttcaatcggaaggatctggccatggagtccctgttcggcgcctccaggaggacgacggctggcggcggcttcgactcgctcaagcgtctgggccacatctcccccgccgtgcagtcccacctcaagcacgtgtacctcaccctgtgctccgcgctggccttctccgcgctcggcgcctacctccacatcgccctcaacatcggcggcaccctcaccaccatcggatgcctggccgccatcgccttcctcatctccctccccgcgtcccagcatcaggagaggaaccgcttcgccttgctcatgtccgccgcgctcctrcaaggggcctccgtsggcccgctcstcgatctggtccttcacttggaccygaggatcctggtcacggcsttcgtcggsacsgcgattgctttyggatgcttctcggctgccgccatmatcgccaagcgcagggagtacctgtacctcggcggcttgctctcctctgccctctccattcttctctggctgcagtttgctgcttccatctttggccactactacttcacctttgagctctactttggcctcctggttttcctgggatacatggtgtatgacacccaagagatcatcgagagggcacaccatggggacatggactacatcaagcacgcactcactctcttcaccgactttgttgccgttcttgttcgggtccttgtcatcatgctgaaaaatgcccaggagaaatcccaagaggacaagaagaggaagaagcgctattgaatgraraaacaaaggcactcttttttttcctgaawttatytactctatmtagtagtgmtagtaaagacasaaagcttggatcagcttgtstagtkttyyggctggctactcggatcagcttgtstagtgttytkgckg

SEQ ID NO: 879 - DNA, 1146 bp, Panicum virgatum
ctcgtcgtcctccccgaactcgagccgagccccgccccgccctgccccgagcgcgtcttccccacctcggcttgtcccctctaccaacgccatggggtcgtcggaggccgacgaggaccagctcctcaagagcttcctggcggaggtcagcgaggccgagcgcgaaaatgaagtgctcaggatacttggttgcttcaagttaaacccctttgagcatcttaagttgtcttttgattcatctccagatgaggtgaagaagcaatataggaagttgtcattgttggtccatcctgataaatgcaagcatccgcaggcacaagaagcttttgcagctctggcaaaagcacagcaactcctgcttgatccacaggaaagaggatacattctcgaccaagttactgctgcaaaagaagagttgagggcaaagagaaaaaaggaactgaagaaggacagtgcatccaagataaaatcccttgtagacgagggaaaatatgaagagcagttcgaacgatcggatgaatttcagcagcagctaataattaaagtgcgtgaaattttgacggagaaagagtggcgtaggagaaaaatgcaaatgaggatatcagaggaagaaggaagacttaagaaggatgaggaggaaacaaaagagatgtggaagaggaagagagagcatgaagagaagtgggaggagacgagagatcagcgggtctctagctggagggatttcatgaagacaggaaagaagggacggaaaggtgaaatcaaacccccaaaacttaagactgaagatccaaacaagtcttatgtgcagaggccagtgaagcgcacttaagaggaatgctattggtgtctgcaatcaaaaaaatatcctgtagcgatccttgatgccactgccccctgatccgagctggcaaccctgccatgttctgcaggctgtaagtttcaaatatgcctgggaggctcaactgtagtcagtgaacagatcaacagaacggataattactagcgaaatgcccatattactccctagagtgatattggattgatgtacccatgaggcgaaaattttactggaaagtagaagattttgttggaaaagaaccctactgaagtgaatgttgaaaggcccatctcattactggattc

SEQ ID NO: 880 - DNA, 614 bp, Panicum virgatum
tggctgctgagcttcttcttccgcaaggaggaaaaaaaaggatccagaggccagggttcgtttcttaccggaccgtgtcgcgagtcccgatggcggagccggcggagccggcgaagcccgaggtgacggaggaggctaagatggacctgctcgaggacgacgacgagttcgaggagttcgagatcgaccaagagtgggacgacaaggaagaaggcaacgaagcacttcagcaatgggaggatgactgggatgatgatgacgtcaatgatgacttctcgctgcagttgaggaaggagctggagagcaatgcgccgaagaactagccagcgtatgcagccttgtattgagttggagagtggtgtgatggtgtccaaggactagttagcttatgcagccttgtatccattattgtcagataggaactgctgtacggtgaccatggttgggaaactgctactgttgttccgttctcgtccttgttggcatggtcactgatgttgtcgttccgtttgcttttaatggatcatttccctgtttccgactactaataactgatgaaccttggttaaaaggcagcaatgagaattgtatgctacatgttacgctgttcgctt

SEQ ID NO: 881 - DNA, 1042 bp, Panicum virgatum
tcctcgtcctctcgtcgctgctcctcctcgcgtccggcgaggtcttcttcgaggagcgcttcgaagatggctgggagtcccggtgggtggaatctgattggaaaaggagtgaagggaaagctggaaggttcaagcacacagcgggaagatactctggagatcctgacgacaaaggaatacaaacaacaatggatgctaggcattttgctatctcagccaagttcccacaattcagtaacaagaacaggacactggtggtccagtactccattaagtttgagcaggatatcgagtgtggtggtggatacattaagcttatgtccggttatgtcaaccagaaaaaatttagtggggacactccatacagcttgatgtttgggccagatatatgtggtactgatacaaagaagctgcatcttatactttcttaccaagggcagaattatccaatcaagaaagatctagaatgtgagacggacaagttaacacatatgtatactttyattcttaggcctgacgcatcttatagcctacttgtcgataaccgtgaaagagaatctgggagcatgtacactgactgggacatcctccctcctcgtaaaatcaaggatgttcatgccaaaaggcctaaggattgggatgacagagaatatattgatgatcctgatgatgttaagccagagggctatgattctatcccaaaacagattcctgatccaaaggacaaaaagcctgacacatgggatgacgatgatgatggcatatggaagcccagaatgatatcaaatccagcatacaagggaccatggaaacgcaagagaattaagaatcctaactacaagggtaaatggaagaccccatggattgataatccagagtttgaggatgatccagatctgtatgtgctgaaacctttgaagtatgttggaattgaagtttggcaggtaaaagctggttcagtttttgacaacattctgatttgtgatgaccctgagtatgcaagaaaggttgttgaggaaactgtgggtgcgaatagggaggc

SEQ ID NO: 882 - DNA, 520 bp, Panicum virgatum
tccccgcacgcgaagcagggcgcagcgttgatggcaacggcaccggcgccggcggacccgaaggcggaggcggccaagatggacctcctggaggacgacgacgagttcgaggagttcgagatcgaccaagaatgggacgacaaggaagaaggcaatgaagctgtccagcagtgggaggacgactgggatgatgatgacgttaatgatgatttctcgcagcagctgaggaaagaactggagggagcccagaagagctgaagtgttttcttccgtagtataaatgttactcttgtatggccgttactttctgaaccgctgtgtgcttcagacagttatgggtgcgcgtctgggagcaccacctaatttgcggaatatttctacagggaagtttatggtcgtgctgtagtttccatattatcagtgaatttctatatgaacggcatgagtatgataccagaaagtttataaatatgcggcaatttgcccctcaatcaagttgaagctaacgatcacttytttt

SEQ ID NO: 883 - DNA, 395 bp, Thellungiella halophila
ttttggtttcgaattattcgacgagagaaaatggcttctcatcaagaacagggtttcaaagctggtgagaccagaggccagactcaggagaagacaagacaagctatgggagcgatgggggagaagacagatgtagctaaggacaaaactcaaggagcagcccaatcagcccaacaaaagacccatgaaacagctcaagcagctaaagacaaggcatctcaagccgcacaaacaactcaacagaaagctcaagagtccaaggacaaaacgggaagctacatgtcagagacaggagaaacaattaagaacaaggcacaagatgcagcagaatataccaaggagactgcagaagctggtaagaacaagaccggtgggatcttgggccaaaccggtga

SEQ ID NO: 884 - DNA, 585 bp, Thellungiella halophila
cattcacatataattttctggcttttttagagttgtgaaaacattttgttatktttgtttgctggaagaatccaaagtcagaggaaaatgggtgttagagagaaggatccgttagcccaattgagtttgcctccgggttttagattttacccgacagatgaagagcttcttgttcagtatctttgtcggaaagttgcaggctatcatttctcgctccaggtcatcggagatatcgatctctacaagttcgatccttgggatttgccaagtaaggctttgtttggggaaaaagaatggtatttttttagcccgagagatcggaaatatccgaacgggtcaagacccaacagagtagccgggtcgggttactggaaggcgacgggtacagacwagatcattacggcggatggtcaccgtgtcggaattaaaaaagctctggttttctacgccggaaaagctccaaaaggcacgaaaaccaactggataatgcacgagtatcgcttaatcgagcattctcgtagccatggaagctccaagttggatgattgggtattgtgccgaatttacagaaaacgtcaggagctc

SEQ ID NO: 885 - DNA, 929 bp, Thellungiella halophila
ctccttccattataatgagcagtgttcatcatatctcggacgacccgaaatctcctctcttaccagtcgtccacaatgacgacgaaccatgcgaaagacaatcggtgggacaacatctccggacaatattcacgcctaagaattgttacatcgctctcggtcctcttctttgcgccgtcgtgtgtctttgtgcacgcctcggcggagatgaaacgacgacggcgaggaacatgctcggcgttcttgtttggatgttcgcctggtggttgacggaggccgttccgatgccgatcacctccatgtcgcctcttttcttgtttcctatcttcggtatctcggcggctgatgacgtggcgagttcttacatggatgacgtcatcgctcttgtcctcggtagcttcatcctcgctctcgccgtcgaacactataacatccatcgccgactcgcccttaacataacgtcggtgttctgcgtggagccgctaaacgcgccgctgcttctacttggcatctgcgccacaacggcgttcgtgagcatgtggatgcacaacgtggcggctgcggtcatgatgatgccagtcgctacaggaattcttcagagacttccctcgtcgtcttcgtcgtcgtcggaagttgttcctccggcggtagggaagttttgtagagcggtggtgctcggtgtgatatactcggcgtcagtaggtggaatgagcacactgacaggaacaggtgtgaatctgatacttgtcggamtgtggaaaagctatytccctgaagctgatccaatcagtttcagccaatggttcttcttcggtcttcctttggctttgtgcatattctttgtgctttggggtattctatgtgtactgtattgtcctaaaggatcagggaaagctctctctccttatctcccacaagctcatcttcgt

SEQ ID NO: 886 - DNA, 578 bp, Thellungiella halophila
attaggtcaagaagattatcttcagttttgttcttccttcttctttcgtgaggaatctcagagtaaatctcatctgtttttatttggtgtagagatggagacggagaagagtagcaaggagctagggcttaaacacctaggtttcgtgagaatcgcagcgatccacgttctcgttagcttcacgagtctctacgattacgctaagcaaaactccggtcctcttaaatccgccgtcggtaaagtagaaggagccgtcaccgccgtcgttacccctgtctacaacaaattcaaggatgttccagatactctcctcgtctttctcgatcacaaggtcggtgaagtttcggtcaagtttgataagcatgctcctccaatggctaagcaagtggtaactcaagcgagtgtgttgatgagcaaggcaacagagaaggctcaagggtttgtgaaagaggctcgtaccggtggtcctaaagctgcctttaactatgctgcaaccgagtacaagtgtttccttgtgaccaactcagtcaaagcctgggctaaactcaaccagtacaaaccaatccatgcagtgggag

SEQ ID NO: 887 - DNA, 725 bp, Thellungiella halophila
cgtccatttatatatactccaagaattcatattaattataccacgcaaagattaaaacaccgattccsaaacagaaagaaagaaaaaaaagaagaagatttaacaagaaggatcaataattcaatatggcgagtctcatggacaaagccaaggggttcgtggctgataaacttgccggggtcgctaaaccggagggttcggttacggatgttgaccttaaagacgtgaaccgtgactccgtcgaatacttagccaaagtttcagtcaccaatccttacgatcatgcaattccgatctgcgagatcaatttcacttttcacagcgccggccgggaaatcggaaaggggaaaatgccggacccgggttcgttgaaagcaaaggacatgacggttcttgatattcctgtggtggtgccgtacaatatactgttcaacttggctcgagacgttggtgtggactgggacattgactatttgctcgaaatcggcctcaccgttgatcttcctattatcgggaacattaccatccctattaccagcaagggcgaaatcaaactccctacttttaaagatttcttctgatctacttaacctataataccaatatcgtttgtaaaattttaaaagacaaaaaacatcgtttgtaatggtgatgttgatcatgtaatattaataatgtgggttttgcctaaataatcatcaataaatgttatttcgttgtatcaa

SEQ ID NO: 888 - DNA, 1094 bp, Nicotiana tabacum
gggatgcctggaataacagctyatggaggtttttatgagctatgctccccaaagaaaggagaaactgtgtatgtttctgctgcatctggagcagtaggtcagctcgtcgggcaattcgctaagctattgggctgctatgttgttggaagtgctggaagcaaagaaaaggttgaacttttgaagaacagatttgggtttgatgaagcatttaactataaagaggaacaggatttatctgcagctttgaagaggtatttccccgatggaattgatatttactttgagaatgttggaggaaagatgcttgacgcggttcttctgaacatgagaatccatggacgaatcgctgtatgtggattcatctcacaatacaacctggagcagtctgaaggagtgcataacttgttctgtctcatcacaaaacgaatccgtatgcaaggatttttggctgctgattactttcccctttaccaaaagtttgtagaaatggttactccacacataaaagaagggaaggtaacatatgtggaagacatagctgaaggcattgaaagtgcacctggtgctctagttgggctcttctctggtcgtaatgttggcaagcaattggtacgtatttctcgtgaataaacttgtacagtcggggttggaggctagctcacttggtgagttctctgccttccaaaatgaggtggagggttcaaaacctatcagtagcacaacattccccttcctccctcaaccgatgaaataaaaaagaaaacttgtacattcaatttgttatcaacatagatgcgtttgctgtcgtataaccatattgacacgggcttgcagaccacttttaaaaagttcctaggcctccttctcctgttcgatgtgggactgcgcgccttaatgtgttatcaactataactctgtctgattaaaagttgtttgagtataaggtttgtaaacattgtgttggtaatggtttttgtttaatgctagtgtctgcgtaaatgttagtacttgttacttgagatttttgtgtggtgctaatttatgtagctccaacatgttaatacattggacgattttgctgtagcggccgcatg

SEQ ID NO: 889 - DNA, 394 bp, Nicotiana tabacum
tgtgaactatcttcatcatcttaatcctcctatagttcatcgcgacttgaagtcttcaaatcttcttgtggacaggaactggactgttaaggttggggattttggtctgtcacgtcttaaacatgaaacatatctagcaacaaagacgggtaaaggaacgcctcaatggatggctccagaagttcttcgcaatgaacctgcwgatgagaagtctgatgtatacagttttggagtgattctatgggagcttgccactgaaaaaatcccttgggatagcctcaactcaatgcaggtggttggagctgtaggattcatgaatcagcggttagatatcccgaagaatgttaatccacaatgggcttctataattgagagctgttggcatagtgagcca

SEQ ID NO: 890 - DNA, 2073 bp, Nicotiana tabacum
acgccattatttgcttcacygagttcgattctctstttctctcaattyattgtaattgcattttgtatttgrcggaaraatggaagaggattttgatattccaccggcagaaggaatggacgaggatatggatctccccgaygacccgataatgaaagtcggsgaggaraaggaaatcggaaatcaaggtctgaagaagaagcttgtcaaggaaggtgaaggatgggaractcctgagkctggygatgaagttgaagttcattacactggtactctgcttgayggaaccaagttcgattccagtcgcgataggggggacccgttcaagttcactcttggtcaaggacaagtaattaaaggatgggatcaaggtataaagaccatgaagaaaggtgaaaatgctattttcactattcctccggagctggcttatggagagagtggttctcctccaactatcccaccaaatgccactctgcaatttgatgttgaattgctatcatgggcgagcgtaaaagacatttgtaaggacggtggaattttcaagaagatccttgctgagggagagaaatgggaaaacccaaaggatcttgacgaagtactggtcaagtacgaagctctgctcgaaaatggcacagtggtgggaaaatcagatggtgtggagttcactgttcaagatggttatttctgccctgctcttgctaaggctgtgaaaactatgaagaaaggtgaaaaggtccagttgacagtgaagccacaatatggctttggagagaaaggaaaaccagcctcgagtgatggaggagcagtcccacctaatgctacactacaaatcaacttggagttggtctcgtggaaaattgtttcaagtgttactgatgacaagaaagtagtaaagaagatcttgaaagaaggggaaggatatgagaaacccaatgaaggagctgtagttaaattaaaactgatcggcaagctgcaagatggcacagtcttcataaagaagggccatgatggggaaaatgaagatgaactttttgagtttaagacagatgaagagcaagttatagatgggctagatagagctgtaatgacaatgaagaagggtgaagtggcactgcttacaattgcacccgaatatgcctttggttcttctgagtcaaagcaagatttagctgttattcctcctaattcaaccgtgcattatgaggttgaacttgtttcctttgtcaaggacaaggaatcatgggatatgaatactcctgagaaaattgaggctgctggcaagaagaaagaagaagggaatgcactgtttaaggctggtaaatacacaagagcatctaagagatacgagaaggctgccaaattcatcgagtatgatacttccttcagtgaggaggagaagaaacagtctaaagcgttgaaaatcagttgcaacttgaataatgctgcttgcaagttgaaattgaaagactacaagcaggctgagaaactgtgtaccaaggtgttggaactggagagcaccaatgtgaaagctctttaccgcagagctcaagcatatatgaacatggctgatctggatctggctgaatttgacattaagaaagctctcgagattgatcctaacaacagggatgtgaagcttgaatacaaagctctgaaggataaagtcaaggaattcaataagaaggacgcgaagttctatggaaacatgtttgccaagttaaataagctggaaacggcaaattcatctaaatctgctcccaaggaaccagaaccgatgagcatagatagcaaggcataacttgacttagacatgagacatcacataaaagaatcatcattattttctggcatagcgatagtttccatgagatgatgagctttgatatgtgtaatcgagtcgttatagtggacattaggaaaaagtgtttgctgaataagctgactgagatttcggactttgtattggttatttcggatattaagtggatcctcctgtaatagtttttttaggtgaatcgggcatctttcgtgttccataagttatttgttgttgagcggccgcatgagggt

SEQ ID NO: 891 - DNA, 1269 bp, Nicotiana tabacum
tacgcgtttaatttcccaatccagaagtttctacaagctcagagcattgtagcaccaagtgcatacatttcagctgcgactttagcgttgcatttagtgatgagttgggctgtgatttacaagattgggcttgggttactcggggcgtctctgatactgagtttgtcatggtggataattgtaataggccaatttgtgtatattgtgaaaagtgagaggtgtaggcaaacatggaaagggttcagtttgcaggcgttttccggcttgccagtgtttttcaagttatcagcggcgtccgcggtgatgttatgcttggagacatggtactttcaagttgtggttctgcttgctggattgcttgaaaatcctgaattgtctttggatgctctttctatttgcatgacaatttctggttgggtattcatgatatcagttggattcaatgcagcagcaagtgtgagagtgagcaatgaactaggagcaaggcatccaaaatcagcagctttttctgttattgtggttacatcgtggtctttcattctctcagtgattgctgcagccatcgttcttgcattgcgtaatctcatcagttatgccttcactggtggtgaagtcgtggctgcagctgtctccgatctttgtccattgctcgcgatttccctcatactcaatggaattcagcctgtcttgtcaggtgtggctgttggatgtggatggcaaacttttgtggcctatgtaaatgtgggttgctattacattgtcggagttccagtgggtgttcttctcggctttcatttcaaacttggcgctaagggtatatggtcaggaatgttgggaggtacagtgatgcaaacaatcattttaatatggatcactgctcgaaccgattggaataaagaggtggaatcagctcaatataggttgaaaaagtgggatgacaagaaagaatcaattctagaggaatagaagaatctggacaaagaggagattcataccaaagtgttgttcatgttctctcacaaatggggatttagaaagcttaatgattgaggaataataccaaattttgaatgaaaatgaccaagaaaatcatgaacttgacatagaaaaaggtacaattggcaggaaaaaatcatgaacttgacatagtgtaatatttcccmcgcatttaagctgatacatctcaatgactttttgagaatgaaggcatatttgtaacttgtttgctatttgttttcaaatttgttaaatccttgcttctttttttcg

SEQ ID NO: 892 - DNA, 921 bp, Nicotiana tabacum
aaaggagagagcgaaaaataactgaaagtgaaagtgttagaaackmawgcrgmmgttgcaactgagraagagaagaaatgggtacattgagaataccagatgtaattccttctcctactgaagactgtgaatcactcatgaaarcmttcaaaggsctgggaacraatgagaagtcrgtaatatcggtrttggggcacagaratgcaagtcagaggaagaagatcagagaaacctaygagcaactttacaacaggtcccttgtygatgacatttttgmtgaattatctggtgatttcrggaaagcwgtratcmtgtggacatatgagccttctgaaagagatgcgmgactagcaaatgaagccttgaagtcragaaagaaaaccatcacycarttrcaagtgatagtagagatagcytgtgcrtcatctcctgatcatctsgycgckgtaagacaagmatattgtgscctyttcaactgttcacttgaagaagatatcacagcaaatgtycctatgcctgtwcaaaagattcttattggtytagtcaggtcctatagatatgataaagaattggtggatcctagtactgcaaatgcagaagctgctatccttcgcgaagccatacggataaaacagttggatcatgacaattttctgatgatactcagcactaggaatgttcatcagcttagagcaacttttgagtgctataaacaaaattatggattctccattgaccaggatattaagagctgtggaaaaggcctgttggaatctattttgaaagtggttatctggtgcattgatacgcctgagaaacattttgctgaggttgtcagagcctcgattgtcgggataggaactgatgaggattctctaactagagccattgtaactcgagctgaagttgatatgatgaaag

SEQ ID NO: 893 - DNA, 985 bp, Nicotiana tabacum
ggaactggagcttgcgtcaaactgtaaaacatcttaggatcttcagtcggagcgtgaaagtccgattcaatgggagacaacagcgctacaaccaccgcaccttcgccggcgaaaaccgccgcggtggaagatgctcttctcaagcaattcttcgctgaggtcagtgaagttgaacgcgataacgaagttaacaggatcctttcgtgcttcaagttgaatccgtttgactaccttaacctgccatttgattcatccattgatgaagtcaaaaagcaatatcgtaagttatctttgcttgttcaccctgacaagtgcaagcatccacaagcaaaggaggcatttggcgctttagcaaaagcccagcagttattactcgatccccaggagagggattatattctgaaccaggttaatgcagcaaaagaagagctgagagcaaagcggaagaagcaacttaagaaagatactgctagcaaactgaaatcattagtgactgagggaaaattcgaccaagaacatgagcaatcagaagaattccagcatcagctgaagttgaaagttaaagaaatattgacagaacaagaatggaggagaagaaaaatggcgatgaggatatctgaagaggaaggtcgcttgaagaaagatgaggaagaaacaaaagaaatgtggaaaaggaagcgtgagcacgaggagcagtgggaaggaactagagaaaaaagggtgtccagttggagagatttcatgaaaggaggaaagaaggttaagaaaggagaaattcggcctccaaagttgaaaacagaagatcccaataaatcttatgttcaaagacctgtgaaacgaggttaaacacatgttcttagttttgtgtcattgatatttaagcgattctcatctaagtttgaactggcaatggaagtgtaagttctcgcttgtatcaacttgtatctgtagaaaacttaattaatctgcmgcagcggccgcatga

SEQ ID NO: 894 - DNA, 1884 bp, Nicotiana tabacum
  misc_feature (1883)..(1883): n is a, c, g, or t
ttgtactatttccttgagctgaaagaaatcatttactcggttactatctgcttcatactcattaagacttgtaatcatggctaggaagatgctgattgatggagagttggacaaatccggtcaagaagaacagcactatkactttgatttgttcgtaatagtgctggaagtggtggggttcgagctggtcgattttctgcccaatatggagctaaggttgcgatctgtgagcttccatttcatcctatcagctctgaacttagtgggggagttggtggaacgtgcgttattcgtggttgtgtccctaaaaagattttggtttatggagcagcctatgggccggagctggaggatgcaaggaattatggttgggaagtgaatgagagagtcaatttcaactggaagaaacttttgcataagaagactgaagagattgtacggttaaatgggatctataagaggctactttcaaatgcaggagttaaactctttgaaggtgagggaagggtgataggtccaaatgaagttgaggtaattcaactggatggcaccaagataagctattcggcgaagcacattctaattgcaactggtagtagggctcatcgtccaggaattccgggacaggagctagccwtaacttcagatgaagccttgagcttggaagagttaccaaagcgtgttgtgatacttggtgagggtacattgctgytgagtttgcttcatatggcgaggaatgggtgcacagtggatctatgtttcagaaggaacttccactgagaggttttgatgatgaaatgcgagctgctgttgcaagaaatcttgaaggcagaggaatcacyatgcatccttrcacgacattgactaagyttgaaaaracrgaggatggtatcaaagtgcacacagaycatggtgaagtgataktggcagaygttgtgctctttgcaactggycgtctccctaacacaaaaaggttgaatctggatgctgttggtgttgagcttgacaagatgcaagccgtgaaggtagatgagtactctcgcaccaatgtrcckagcatttgggccatcggtgatgttaccaatcgcatgaatcttacaccagttgctttgatggaaggaacctgttttgcgaaaactgttttcggcagaaaacctacyaagcctgactactcacatatcccatgtgcggtcttctgcatcccgcctctttctgttgtggggcttggcgaagaacaggccatagagcaagtaaatggtgaagtttcagtttacacgtcaacattcaatccaatgaagaacaccatttctggacgacaagagaagtcagtaatgaagcttcttgttgaggccgagacagataaagttttgggagcatccatgtgcggtccagacgcaccagaaatcatgcagggcattgccattgcactaaagtgtggagcaaccaaggaacagtttgacagtacagtgggaattcacccttcagctgcagaagagtttgttaccatgcgttcagagacgaggcacgtctcttcaaacaaaccaaagacaaatctatgaagatgtaagatgtgatgaaactatactaccacatagatggacctttgaggaaaaaaaaaatacttcgtgcaatatttacatacatatgtacacgaaaaagggtagtgaaaaatctatttaacccttcatagtttttgctacatgatgcagtttttattggtttaaaatatgttaaagaggaccaacagagaatactggcaatagtaacatctgcatgttgaacaaaactagtttggtttttgataattgtattagcagtaaattttcacttcgcaatgatttggtgacaatattataatataatttacgcctttagtaaaacana

SEQ ID NO: 895 - DNA, 1224 bp, Nicotiana tabacum
agaatcagtgtcacctatctcagaggctcttaaatctcggtctgataattctaaaatatcctcgctactggagtgtttggccattattacctttattggtggcgaagaaccggagaaaacagaaaagtcgatgcaattgatgtggcaagtcattcatccaaaactgggtcctaatgtttcatctgctaaaccttcaccagcaatgataacagcagttgtatcttcttggtctttcctccttactaccatggatggrtggacmcttaacccaaaaagttggcaagggtcaatctcctacttctcaactcttctagacaaggaagaycgatctgtgcgcattgcagcaggcgaagcacttgctttagtttttgaagttgggagtctggaraagttttctggtgaagctaaaggatctagtgacagctccacagwtgargctaacaaatctagggaattattacatatacagggattaagggcaaaagtcctgaaccaggtaagaaccctttcrgcagargctggaggtaaaggatcagccaagaaggatcttaacaaccaaagaaacacatttcgagatatattggaatttctcgaggatgggtatagccctgaggcctcgaccaagattggtggagaaccgcttagcacaagtacttgggctcaacttatacagttaaacttccttaagcacttccttggaggaggattcgtgaagcatatgcaggaaaatgagtttcttcatgatgtatttggtttcacgccgaagaagaaactgcccggtgttgagcaccgtgtatccggcgctgaaaagagattgtttaagtcaccaaattcagaaaaaaacaaggcccgcactcaatttctaaacaagcaaaggatgttgtcccaggacaagaatgttggctactatacggttggtgatgtgtgaaattttcagccaaagccaacctggaacaattgtccgtgtcaaaaatattcattcatagttgcagatttgatgaacaaaatgataaacaaaaggatagttacttgatcattttgttgcctacttggtagtagtcctttatttttcttttacagtaagtatgaattagattggacttggtgcctccacttcatgtagtgcatgaaaaaggccagccactgtgcattctcttatgtttctattgaaacagattctcttaatagatgattcagtgagtgctagttagcggccgcatgagg

SEQ ID NO: 896 - DNA, 1160 bp, Nicotiana tabacum
aaatacaaatagcacaactagtttactaattattggtattccaaagttgtagtccacttgaacgtgtcgcacaatcccatcgctctctcttcaaatgataaaatattaacatcattctattstccaattccttcctcmattttcgcccaatttctcaaattttggcgcaattttccaccctttttaccyaccaaataactactacatgttataaaataaaagcaatgcagtaaaatataaataagaaaagataggaagaaggaagaagtgttttcttctttcactttggtgtatctttccattacaattatatgatcttttataggcataaaaagtaaacatgaaggtagaagataagttatggacatccaatatagcattcaataactattgctataactaacttataattttcccggacaaaattctccaaaccccaaattctagggttttcatattactattgtaatccagttttttyccyttkgaaacrywtacctttaggtttggattctgaattttkrggcgaattttgatcasaattcgaagaaataagagaaagagatgagctttcaagatctagaatcgggtcgatcattgggttcccgtcgtggctatgtgaatgrgaagcaaracccgacccaagccgtggcctcaggaatattccagataaacaccgccgtctccacgtttcagaggctggttaataccctaggtacacctaaggatacccccgawttacgcgacaagttgcacaaaacaaggctgcatattgggcarttagtgaaagatacatctgcaaaacttaaacaagccagcgaaacagaycatcgagttgaagtcagtgctagcaagaaaattacagatgctaaacttgctaaagattttcaagctgtattaaaggagtttcagaaagctcaacgccttgcagctgagagggagacagcatacacaccttttgttccccaagcagttcagccttctatttactcagacggtgagatagatgttacttcagataaaggtccagaacagcaagctctcttggattctagaagacaggaggttttgcttttggacaatgaaatttcctttaatgaagctattatagaggaacgggagcagggaatacaagaagtacaacaacagataggtgaagt

SEQ ID NO: 897 - DNA, 854 bp, Nicotiana tabacum
aagagtttagagaattagttttattattctcaccattttaataattccaaagggtattctctgagcttcttaatttcttttactaaaacaattaatctaaattttgaagatgggtgttcaagaaaaagaccctcttttgcaattaagtttgccaccagggtttcgtttttatcctactgatgaagagcttttagttcaatatttatgcaagaaagttgcaggccatgacttctctatgcaaatcattggagatattgatttgtacaaattcgacccttgggttcttccaagtaaggcactttttggtgaaaaagaatggtatttttttagtccaagagataggaagtatccaaatggatctcgaccaaatagagttgctggtactggttattggaaagcaacgggaactgataaggtcataacatcacaaggaagaaaagttggaattaagaaagcacttgtgttttatgtgggtaaagcaccaaaaggaaccaaaaccaattggattatgcatgaatatagactctttgaaccttcaaggaaaaatggaagttcaaagctagatgaatgggtcctctgtcgaatttataagaagaattcaagtggacaaaagccttatatgtccggtttgaacagcaaagaatacagccatggttcttcacttcatcgtcgtcccatttcgatgatatgctcgaatcgttacctgagatggatcacaagttttctaacttgccgagattggattccctcagaatttccaacaaggtgaaaagttgaatcttgaacgcctggattccgcaactttggattggggcattccttggggggttcaaccaatgccagaattggagccc

SEQ ID NO: 898 - DNA, 1520 bp, Solanum lycopersicum
gaagttaataaattgaatgaacccaaatagagttagcaattcaaaacatggcgaaattcatagagtcaaagttggaaatagtgatgttcccatggcttgcttttgggcatttgattccatttatgaatctctcaaatgaacttgcaaaaagaggtcacaatatcacattcttgttgcctcaaaatgctgaaactagacttcaaaaactcaatctttacccaaatctcatcaaatttcataaactgacaatacctcatgttgatggccttccctatggagcagagacaacagctgatgttcctggaccaatggagactctgttagcaactgcttttgatgaattgtatgatgaaatcaaatcaattcttcaaaatctaaaaccccatttcgttttctttgattttgcttattggattcctgatttagcgaaagaaattgggggtatcaaaactctgatatacctacttatttcccctgctgcactgtgtaaatcaacggataaggctacttttatgacatcaacggctgctgagctagcaaagccaccaccaggttacccttctactactgtggtgttgcatgaaagcgaagctaagttgttgtcatttgtatatcaagaatatggcaagggggtcacgtttcaagaacgattggacaaggcacttagacaatgcgatgtaatagctgcaaaaacatgtagagagattgaaggtatcttttgtgaatacctagcaaatctacttgaaaagccagtcatttacgttggacctgtgattcccgagcccaaaaaagagcaacacgaattatcaaattggctcgagaaattcgagccaggatcagttgtgttctgtgcatttgggagtcaaatgattcttgaaaagacgcagtttcaagagcttgttttaggctttgaattgactgagttaccatttcttttagttgttaaaccacctcaagggacaaattcagtagaagaagccttgccagagggattcaagcaaagaattcaagaaaagggattgattcttgattgttcggtgccacaattggagattttaagacacaaatcagttggttgtttcgtgactcactgtggttatgggtcgatgtgggagtctttggtgttgtgtgattgtcaattggtacttttgccaaggcctattgatcacatttttactgctaggcttatgggacaacaccttaaggttggtgtagaagtggataacgatgaaaacgatatgtttactaaagagaatttgtgcaaggctgtgaaatgtgtgatggataaagatagccaaatcggttgtgttgtgaaagagaatcataagaaatggaaaaaacttctttcgagtcctggattcatgagcaactacatcgataacttcattcaagacttgcatggacttgtagtttaaaaatagttagcaggggtagtttgcagaattcagtgtattgtgttaagaaattctgcttgatatgtatgaataatcgatttcaatcgaatcagaatttataaactc

SEQ ID NO: 899 - DNA, 1065 bp, Solanum lycopersicum
gcgtacccgttaagctgtaaacgttttgggagttttcatccccggtggcgaagtggttgttacgtataacaggagagagattcgcagcggagcgtgaactcaacgcttgatttgatgggagacaacagctctgtcaccgccgcaccatctccgtcgtcggaaaaaacttccgccatcgaggacgcacttctcaagcaattcttcgcagaggtcagcgaggttgagcgcgacaacgaagttataaggatactttcatgcttcaagttgaatccatttgaataccttaacctgtcatttgactcatccattgacgaagttaaaaggcaatatcgtaagttgtctttgctagttcaccctgataaatgcaagcatccacaagcaaaggaggcatttggtgccttagctaaagcgcaacagttattacttgatcaacaggagagggattacattctgagccaagttgttgcagcaaaagaagaattaagatcaaagtggaagaagcagctcaaaaaagatactgctagcaaattgaagtcattagttactgagggtaaatatgaccaagaacatgagcagtcagaggaattccagcagcagcttaagttaaaggttagagaaatattgacagatcaagaatggcggaggagaaaaatggcaatgaggatatctgaagaagaaggtcgcttgaagaaagatgaggaagaaacaaaagagatgtggaaaagaaaacgtgagcatgaggagcagtgggaaggaactagagaaaagagggtgtccagttggagggatttcatgaagggtgggaaaaaggctaagaaaggagagattcggcctccaaagcttaagacagaagatcccaacaaatcttatgttcaaagacctgttaaaagaggttaactcatgtactctgatgggtttttactgcttccataatgccatgaatcctcattgaaagcttgaagtggcttcttgagtgtaagcttcaaccttgtgtaaagttgtatttgttaaaaagctaattattgagcagcaaattacattttgctctccagtgttgaccaggta

SEQ ID NO: 900 - DNA, 725 bp, Solanum lycopersicum
gttcttcaattccttcctccattttcgcccaatttctctatttttggcgcaataattatctaataaaatactccttcctcacatctccttgcaaattcccccaaccccaaattctagggtttccatattacttctctctgtaatccaaatcgttatccggctttgtcccctctgatcacatacctttaggtttggatttctgaaatttggggtgaattttgatcagaattcgaaggaacaagagaaaaaaatgagctttcaagatctagaatcgggtcgatcagtgggtccacgtcggggctttatgaacgggaagcaagacactacccaagcggtcgcctcaggaattttccagatcaacaccgccgtctccacatttcagaggctggttaacaccctaggtacacctaaggacacccctgagctacgcgacaagctgcacaagacaaggctacatattgggcaattagtgaaagatacttccacaaaacttaagcaagcgagtgaaacagatcatcgagttgaagtcagtgctagcaagaaaattacagatgctaaacttgctaaagactttcaagctgtattgaaggagtttcaaaaagctcaacggcttgcagctgagagggaaacagcatatacaccttttattccccaagcagttcttccttctagttacacagacggtgaggtagatgtcagttcagataaaggtcaagaacagcgag

SEQ ID NO: 901 - DNA, 2273 bp, Solanum lycopersicum
aatttaagatatctggaagaatcctgacccttcgtcacgctaaggctctctcaaaaaccttggaacactctagaacctaaaccctttcttttcacactatctgcacaccatttaagcctccatcttcttcatctccaacacgccattatttgctttcagtgagttcgattatatcaatcaatcaatcttctgcctgtgtgttcacatattgtgtttgacggaaaaatggacgatgattttggtattccaccggtcgagggaatggacgaggacatggatctgccggaggacagttcgaccatgaaagtaggcgaggagaaggaaattggaaatcagggattgaagaagaagcttgttaaggaaggtgaaggttgggaaactcctgagcctggtgatgaagtcgaagttcattatactggaactctgctcgacggaaccaagtttgattccagccgcgatagaggggaccccttcaagtttactctcggtcaaggacaagtaattaaaggatgggatcaaggtataaagacaatgaagaaaggtgaaaatgctattttcaccattcctcctgagctggcttacggagagagtggttctcctccaactatccctccaaatgccactctacaatttgatgtggagttgctatcatgggtgagtgtaaaagacatttgcaaggatggtggtattttcaaaaagatcctcacagagggggaaaaatgggaaaatccaaaagatcttgacgaagtattagtcaagtatgaagctcagctcgaaaatggcacagtggtgggaaaatcagatggagtggagttcactgttcaagatggtcatttttgtcctgctcttgctaaggctgtgaaaactatgaagaaaggtgaaaaggtccaattgacagtgaagccacaatatggcttcggagagaaaggaaaaccagcctcgagtgatggaggagcagttcctcctaatgccacattacagatcaacttggagttggtctcctggaaaactgtttcaaatgttactgatgacaagaaagtagtaaagaagatcttgaaagaaggggaaggatatgagagacccaatgaaggagctgttgttaaattaaaactggttggcaagctgctagatggcacagtcttcacaaagaagggccatgatggggaaagtgaagataatctttttgagtttaagacagatgaggaacaagtaattgatgggctggacagagctgtcatgacaatgaagaagggtgaagcggcgctgcttacaattgcacctgaatatgcctttggttcatctgagtcgaagcaagattcagctgttgttcctcctaattcaactgtgcattatgaggttgagcttgtttcttttctcaaggacaaggaatcgtgggatatgagtaccccggagaaaattgaggctgctggcaaaaagaaagaagaagggaatgcactgttcaaggctggtaaatacgcaagggcatctaagagatatgagaaggctgctaaattcattgagtatgatactaacttcagtgaggaggaaaagaaacagtctaaagcattgaagatcacctgcaacttaaataatgcagcttgcaagttgaaattgaaagattacaagcaggctgagaaactgtgtaccaaggtgttggaactggatagtgcaaatgtcaaagctctttaccgcagagctcaagcatatatgaacatggctgatcttgatctggctgaatttgacattaagaaagctcttgagattgatcctgacaacagggatgtgaagcttgagtacaaagctctaaaggagaaagtcaaggaaattaacaagaaggacgcaaagttctacgggaacatgtttgcaaagttgaataagcaggattcatcaaactcagccaactctgctcccaaggaaccagagccgatgagcattgatagcaaggcataactttaactcagacatgacataaaaaggatcagcatcatcattatcttgacggttcatatatgccatggagtcgttatagttggattttaggaaagagtgtttgctgaataattttactgtaatttctgattctgcattgggtactatcaatggatccctcttgtaatggagtatcatctggcatctttgctgtgacatattttggttattgtgttctgtcattttgttgagtggaattaattgaatgtcgttcgaaattgatgtaagccaaaatcagtagtgaagaccttacaataatagtagtaaaattttctcaacgttca

SEQ ID NO: 902 - DNA, 760 bp, Solanum lycopersicum
taggttttggatttctgaattttgatcaaaattcgaagaaatgagctttcaagatctagattccggtcgatcatcgggtcctcgtcggagcaatgtcaacgggaagcaagacgccactcaagctttggcctctggaattttccagatcaacaccgccgtttccacttttcagagactggttaataccctaggtacccctaaggataccccggagctacgtgacaagttgcacaagacaagactacatattgggcaattagtgaaagatacttctgctaaacttaagcaagccagcgaaacagatcatcgaattgaagtcagtgctagcaagaaaattacagatgcgaagcttgctaaagattttcaagctgtattgaaggagtttcaaaaagctcagaggcttgctgctgagagggaaacgtcatattcaccttttgttccccaagcagttcttccttctagttacacaaacagtgagatagatgtctcttcagataaaagtcaagaacagcgagctctacttgtggaatctagaaggcaagaggttgttcttttggacaatgagatttcatttaatgaagctattatagaggaaagagaccagggaatacaagaagtacaacaacagataggkgaagtgaatgatattttcraggatcttgccgkgcttgttcacgagcaaggaaccatgattgatgatattggttccaacattgagaactctcatgctgcaactgcacaagggagaacacaacttgct

SEQ ID NO: 903 - DNA, 176 bp, Solanum lycopersicum
agtgggaggacaaagagaaaggcaaagaagtaacccaacaatgggaagatgattgggatgatgatgatgtgaacgatgacttctctctgcagctcagaaaggaattggaaatcaacactgagaagaaatgagctacatttgcccatgaatttgttttcttctcaatgttggaccat

SEQ ID NO: 904 - DNA, 1595 bp, Solanum lycopersicum
attgggcaaatggctctttccaagaatgaaaaaagaaaaagtctactactagtctcctcacttgaatcatttctactagttttgttactgttttcaattattacatcttcattatctgagatcttctttgaagaacaatttgatgatgattggcagagcagatgggtgaagtctgactggaaaaggagtgaagggaaagcaggctcctttaagcatacagctgggaaatgggctggtgatcctgatgataaaggtattcagacgtcaaccgatgccaaacatttcgccatctctgctaagataccagaatttagcaacaagaatagaacattggttgtacagtactctataaagcttgagcaagacattgaatgtggtggaggttacataaagcttctctctggatatgtcaaccagaagaagttcgggggagatactccttacagtatgatgtttggaccggatatctgtggtacacagacgaagaaacttcatgttatactttcctaccaaggccagaattatccaatcaaaaaggatctgcaatgtgagacagacaagttaacccatttctacacattcattcttagacctgatgcatcatacagcatctggatagatggccgagagagggattctggaagcatgtatacagactgggatatctttccccctcgaaaaattaaagatgtaaatgcgaaaaagcctgcagattgggatgatagagaatatatagaggatccaaacgaggtcaaaccagagggatatgaatctattccaaaagagatccctaacccaaaagctaaaaagcctgatcactgggatgatgaagaggatggcatctggagaccaccaaaaattcctaacccagcatataagggtccatggaaacggaagaaagtgaagaaccctaactataaaggtaaatggaagaccccttggatcgataatccagaatttgaagatgatcctgatctctatgtgttgaagcctatcaaatatgttggaatcgaagtttggcaggtgaaggcaggttctctatttgacaacatactgatatgtgatgaccctgattatgcaaagaaagtgattgaggaagtctttgctaatagggagactgaaaaggaggcttttgaggaggcagagaaagtgagaaaagcaaaagaggaagaggaagcccaaagagcaagagaagaaggtgaaaggaggagaagagaaagagatagagataggggtagggacaggcacagagatagaaacaagaggcgctatcgccgtgattatgatgatgactatcatgatgaactttgaacttggtgtaaaaggccacacagacagatggttccactcatttgggctttttgtgttcttgttgtattctaatcttaacagtaactttatttttgcatagtccaatgtgttaggcttaagacaagagagattgtactatttccatcttatttagcttttttggcaaagcaaaacatgactcaatattttaaaatctctctacctcacaaggggtgaacgtaagatctgcttatatcatcctcctcagactttacttatggaaatatacatggtttgttgttgta

SEQ ID NO: 905 - DNA, 326 bp, Solanum lycopersicum
agagtggkaggacaaagagaaaggcaaagaartmacccaacaatgggaagatgattgggatgatgatgatgtgaacgatgacttctctctgcagctcagaaaggaattggaaatcaacactgagaagaaatgagctacatttgcccatgaatttgttttcttctcaatgttggaccatgttatttctattgtgggttcagatgtttccctatgtttgtactcctccttatctcactgataaaacttagttttcacccttcttgttgacatatgagacttgtggcacacaaacttgaattttagttacctgtgctcatagtgtgagc

SEQ ID NO: 906 - DNA, 2380 bp, Solanum lycopersicum
atgtataaaaaaaacaatttcatcacttcaacacagttgacacgttgaatctgtagctttcgattagttttctgtttcttttttcttctttgttaaggttcttttttgtttacgcagagattacatagagtcgcctaaaagttgttcttgtaggcttagatcaccaatatatgatctgggtatgatctattttctgtaaagatccgacctttatgtgaattttctaggtttgatagcttctaggtcttaattttgacttttcttgatctgggtaattgttatatttgtctatctagagctaaagatgaaggaaaagctagggtttttagtgtgtgtttggtttcttgtaattgggtcttgtttgggtagatttgtggtggaaaagaatagcttgagggtaacttctccagactcgatcaaaaatgtgtatgagtgtgcaattgggaattttggggttccacaatatggaggaactatggttggtattgttatgtaccctaaagctaatcagaagtcctgcaaggattttgcagattctgatatttcattcaaaactaaggctggtggtatgcctgttttcgtccttgtcgatagaggagactgctatttcacacttaaggcttggaatgctcaaaaggctggagctgctgctattcttgttgctgatgatcgcaatgaacctttgattaccatggacactcctgaggaagaggatgcaaaggcagattatctgcaaaatataactattccgtcagctctaattagtcaatcgcttggggatagcatcaagaagcaactatctaaaggggagatggttaacataaacctggattggagagaggctcttccgcatcctgatgaaagagttgagtacgagttttggaccaacagtaatgatgagtgtggtcctaagtgtgaaagccagagagagtttgtcaaaaacttcaaaggggctgcccagatacttgagcagaaggggtatacacaattcagtccccattacataacttggtattgtcctgaggcatttattttgagcaagcaatgcaagtctcagtgcatcaaccatgggagatactgtgctccagatcctgagcaagacttcagcaaaggttatgatgggaaggatgttgttttacaaaatctgcgccaagcttgcttttataaggttgccaatgatagcgggaagccctggttgtggtgggactacgtcactgactttggaatccggtgtccaatgaaagagaagaagtacgataaggagtgtgcagatcaagtaatcacatcccttggttttgatgtaaaacagatagataaatgtgttggagatcctgaagctgatgctgataaccctattctaaaggctgaacaagaagctcagattggaaagaactctcgtggagatgtgactatcttgccaactcttgtgataaacaataggcagtacagaggcaagttggacaagggagctgttctgaaggccatttgttcaggtttcgaggagacaactgagcctgcaatttgcttaaccgatgatatacaaacaaatgagtgcttagagtccaatggtgggtgctggcaggacacagctgccaacattactgcatgccgggatacattccgtgggaaagtctgtgagtgcccgacggttcagggagtaaaatttgttggtgatggttattctcactgtgaagcatctggagcattacgctgtggattaaacaacggaggttgttggaagggaaccaaggatggaaggacatattctgcctgcatagatgaccacacaaagggttgtaaatgtccaccagggttcaaaggagatggagtgaatctttgtgaagatattgatgaatgcaaagaaaggctggcatgccagtgtccagattgtaaatgcaagaatacctggggtggttatcaatgcagttgcagcggcaatttattgtacatgcaagaacatgacacgtgtatagstgcaggcaatgatggaaaagcagcatttagctggggtcttgtttgggttatcatcttgggtttggcagttgcaggagctggagcatatgccgtgtacaagtataggatccggagatatatggattcagagatccgtgccatcatggcacagtacatgcctttggataatcagggagaggtgcctaaccacatatcccacggaaatgtctgataatattccattgattgcgcggaacgccatcagctctttttccagttgtcacgaggttctttatgcttgtgtaactctcactgttcagcgaggttctttttatgtatatgtttgtcataacagtatacacataaactcccaattatgataggggaaattttccgaaacatgcactatctatcttcttttcactgg

SEQ ID NO: 907 - DNA, 2066 bp, Solanum lycopersicum
ctttttccaactttatcctctttcttcagtcaccggaattgatggcttcgccggaaaacaacatttaccggccatttctacaaaacaatgtaacatcattatcaccacaattatctgaaactcacaactttgaatcaagcaacgagctcgaaactgtgcttttggacactgaaataactctctggagtaaactccgattagcgacatggatagaaatgaagctcctcttcttccttgctgctccggcggttatggtttacatgattaattacatcatgtctatgtcgactcagatattctccggtcacttgggtaatcttgagcttgctgctgcttcacttggaaatacagggattcaagttttcgcgtatggtcttatgttgggcatgggaagtgcagtggaaacactatgtggtcaagcatttggggcaaagaaatacgatatgcttggtgtttatcttcaaagatcgacagttctgttaactctaacaggaattttactcaccatagtgtacattttctgcaagccaattctaatattcgtaggccaaactgagagaattgcagcagcagcggcattgtttgtgtacggtttaatccctcagatatttgcctacgccattaattttccgattcagaaattccttcaagctcagagcattgtagctccgagtgcatacatctccgctgctacgttagtgttgcatttggggttgagctgggtggtgatttttaagattgggctcgggttgcttggggcgtcattggtgttgagtttgtcgtggtggataattgttataggccaatttgtgtacattgtgaagagtgaaaagtgcaaacagacatggaaagggttcagttggatggcgtttaccggcttgccggagttcttcaagttatcggcggcctccgcagtgatgctgtgcttggagacttggtactttcagattgtggtgttgcttgctggcttgcttgaaaatcctgaagtggctttggatgctctttctatttgcatgtcaatttctggttgggtcttcatgatatcagttggattcaatgcagcagcaagtgtgagagtgagcaatgaactaggagcaaggcatcccaaatcagccgcgttttctgttgtcgtggttacctcatggtctttcattctctcagtgattgctgcagtcatcgttcttgcattgcgtaatctcatcagttatgccttcactgaaggtgaagtcgtggctgaagctgtctcggatctttgtccattgcttgcgctttctctcattctcaacggaattcagcccgtcttgtcaggtgtggccgttggctgtggatggcaaaccttcgtggcctatgtcaatataggctgctattacattgtcggagttccattgggtgctcttctcggcttttacttcaaacttggcgctaagggaatatggtcaggaatgctgggaggtacagtgatgcaaacaatcattttaatatggatcaccgctcgaactgattggaataaagaggtggaagcagctcagagtaggttgaaaaggtgggatgacaagaaagaatcaattctagaggaatagatgaattttggatggacaaaaaggagattcatgctaagggattttcccatgttttctctaacaaatgaggtttccacaaagctaataatgtagtaatagtatcaatttttgaatgaagatgatcaagaatcaagattaattatgaagttgatatagaaaattgtagtcaaggtccaaaaaattatttcccatccatttaagatgtaacttgccattgattttttatttttgtaatgtgtatgttaaatatctatacaagtggatgaattagtgagggagtttgaagctcgatttcattattgggtaacattaatatcctgcctattgcaaaatttctgtaacgaaccaaagattggacatgcaaaagtaatgattgaaattatcgcttgtttgacatgttttgtaataaaattgtatcgttgttattggttaaaaatataatttttaacatgatggtatcagaatcaagatcacgagtttcctagg

SEQ ID NO: 908 - DNA, 1301 bp, Triphysaria versicolor
ggacaaaatagtgtaccaactttcatataaccctyggctatacccaagcggcaktcgatatagagagcgaaaagaaaaaaaaaaaacactgaaacacacacacaaaaatggcagaggtgagcaataaacagattgttcttaaggactatgtgacgggttttccaaaagaatcggatatgattctgaaaatatccaccgtccgattgaaggtccccgacggctgcaacgacgtcgttttggtgaagaatctctacttgtcttgtgacccttacatgcgacctcgtatgacgaaaacggaaggcagctatattgactcttttacccccggcatgaatataactgggtacggagttgccaaagttgtcgattcttcaaatcccaacttcaagaaggatgagttggtttggggcatgactggctgggaagagtacagccttatcaaatctaccgagggtctatataaggttccgactaccgatgttcctctctcgtactacaccgggattcttggtatgcctggtatgactgcctatgctggtttttatgaggtttgctctccaaaaaagggcgaaactgtgtacgtctctgcagcatctggagctgttggtcagcttgtcggccagtttgcgaagtcgatgggatgttatgttgttggaagtgccggaagcaaagataaggttgatctcttgaagaataaattcgggtttgatgatgcattcaactacaaagaagaagctgatttggatgcagctttaaaaaggtattttccgaatggaatcgatatttacttcgagaacgttggaggaaaaatgctcgacgctgtgcttctcaacatgaggctccacggtcgcatagccgtttgtgggatgatctcacaatacaacctcgaaaagccggaaggtgtacacaacttgttcaatctcatatctaagcgtatacgaatggaggggtttttggttttcgactattaccatctctatccgaagtatttggagatagtgttgccgcttataaaagacgggaaaataacatacgtggaggatttagctacgggcattgagagtgcacctggtgctcttgtaggcctcttctcggggcgcaatgttgggaagcaggttgtggttgtggctaccgagtgagaatctatattattatgatgtttatgatgatcatgttcatgattactatgttatgaacggattatgagtggatatgaataatcaagttttctgcttgagtttggatcatatgtgatgtttaatgtgaataaaaagtcatattaataaacttattcacagaca

SEQ ID NO: 909 - DNA, 1455 bp, Triphysaria versicolor
  misc_feature (1289)..(1289): n is a, c, g, or t
tacaaaagttattcggagctttttttctactgtttttttttgtcatggcgaggaagatgcttatcgatggtgagctcgacaaaaccaatgaggtggagagtcattatgacttcgatctatttgtaattggggctggaagtggcggtgttcgcgccggtcgtttttcagcgcaaaacggagctaaggttggtatctgcgagcttccgtttcatcccgtcagctctgaagttattggcggtgttggcggaacttgtgtcattcgtggttgtgttccaaaaaagattttggtctatggtgcttcttatgggcctgaactggaggatgcaaggaattatgggtgggaactgaacgagagaaatgatttcaattggaagaaactcctgaaaaagaagactgaagaaatagttagattaaatgggatatacaagcggctactttcaaatgcaggagttaagttatatgaaggagaagggagagttgttggtccaaatgaagtcgaattgattcagttggatggaacgaaaattaactactcggcaaaaaacattctaattgcaactggtagccgggctcagcgtccacctattccaggccaggagttagccatcacttcagatgaggcattgagcttggaagagttacctaagcgagctgttgtacttggtggagggtatattgcggttgagtttgcttctatttggcgagggatgggttcgacagtggatttgtgtttcagaaaagaacttcctttgagaggttttgatgatgagatgcgagcagcagttgcaagaaatcttgaagggargggtattaacctgcatcctaggacaaccttaactgagctggttaaaacggaacatggtataraagttcgcaccgaccatggtgaagaaattgtggctgatgttgtactctttrccactggtaggrctcctaacactaaaagattaaacctcgaagctgttggtgttgagcttgacaagacaggagctgttaaggttgatggatattctcgtaccaacatacccagcatatgggccataggtgatgttacaaaccggatgaatcttactcctgttgccttaatggaaggaacctgctttgcaaaaactgtttttggtggagagcctactgagcctgattatggtcatattccttgtgctgtgttctgcataccaccactctctgtggttggtctcagcgaggaacaagctatagagcaagcaaacggcgaccttttggttttcacatcatcgtttaatccaatgaagaacacaatttctggacgntttagaaaaaagctaggcccwwatcatgcgccgcaggctctgcgacaaaaacaggatggccaawgcaggttccattcakwmaggcaacgrgcgtwwgattcctccagwttgtaacayaacgttttgccmatatgcarctatgtsawamatgcrgggtgagcactcg

SEQ ID NO: 910 - DNA, 1020 bp, Triphysaria versicolor
gaaaatcaaaaagctccgatgggtgatatcagtggaaccacctcctcggccgctgcttccacagccgacgatgatcttcttctcaagaaattttttgccgaagtcggcgaggttgagcgcgacaacgaagtcaacaggatcctttcatgcttcaagttaaatgcttttgagtatcttaatctaccatttgattcctctattgacgaggtgaaaaggcaatatcgtaagttgtcattgcttgttcatcctgataaatgtaaacatccacaagcaaaggatgcatttggagcgttagcaaaagctcaacaattattactcgatccacaagagagggattatattttgaatcaagttactgctgccaaagcggaacttagatctaagaggaagaagcagctgaagaaaaacactgctaataagctaaagtcattagttgacgagggaaaatatgagcaggaatatgaaagatccgaggcattccagcagcagttaaaaatgaaggtcagagaaatcttaacggatcaagaatggaggagaaggaagatgcagatgaggatatccgaggaagaaggtagattaaagaaagacgaagaagaaaccaaagagatgtggaaacgaaagcgtgaacatgaagagcagtgggaaggcacaagagaaaagagggtttccagctggagagactttatgaagggtgggaagaagactgcaaagggagagcttcgacctccaaagctgaagacagaggatccaaacaaatcgtatgttcaaaggccggtgaaacgaggatgatgataattgtggccctcatacttcctgcttattgtgttcgataagacgctgaatttgtagtgctataaattgtattgagttatgcaccaagttgggctgctactacatctcacttgaatcatgtccagtgaaagttattactgtgtataatgttctctaaaggcatagccaagcaccttgtgcaatgaatatcttcattatattagtttatgttggcagttttattgctta

SEQ ID NO: 911 - DNA, 539 bp, Triphysaria versicolor
tactacaccgggattcttggtatgcctggcatgactgcctatgctggtttttatgaggtttgctctccaaagaagggcgaaactgtctatgtctctgcagcgtcgggagctgttggtcagcttgtcggccagtttgcaaagtcgatggggtgctatgttgttggaagtgccggaagcaaagataaggttgatcttttgaagaataaattcgggtttgatgatgcattcaactataaagaagaagctgatttggatgcagctttaaagaggtgttttccgaatggaatcgatatttacttcgagaacgttggaggaaaaatgcttgacgccgtgcttytaaacatgaggctccacggtcggatagccgtttgtgggatgatctcacaatacaacctcgaaaagccagaaggtgtgcacaatttgttcaatctcatatccaagcgtatacggatggagggatttttggttttcgactattaccacctatatccaaagtatttggagatagttttgccgcttataaaagacgggaaaataac

SEQ ID NO: 912 - DNA, 1493 bp, Triphysaria versicolor
acagttatggcaacgcttaagctacawgscamtggcatcaattttactggtgctaatatyttcwctattttgctcttcatttgctgaaatcatttttgaggagcggtttgaaggtggttggcaagatagatgggtgaartctgattggaaaaggagtgaggggaaagctggatcgtttaagcattcagctggaaaatggcatggtgatcctgatgatagaggtattcagacaaccactgatgctcggcattttgctatatctgcgaagataccagaattcagcaataagaatagaaccttggttgttcaatattccattagacttgagcaggatatcgaatgtggtggtggttacattaagcttctttctggttacgttaaccaaaagaaatttggtggggacactccttatagtatgatgtttggacctgatatatgcggcactcagacaaagaaactacacgtcatactttcatatcagggtcaaaactaccccatcaagaaggatttgcaatgtgaaacagataagttaacccatttttatacattcgttcttcggcccgatgcatcatacagtgtcctggtcgatggtcgagaaagagattctggtagcatgtatactgactgggatattttacctccccgcaaaattaaagcggtgaatgcaaaaaagcctgcagactgggatgatagagaatatataaatgacccaagtgctgctaaacccgagggatatgattcaattccgcgtgaaatacctgatccaaaggcaaaagagccatatgactgggatgaagatgatgatggaatatggaaagcacccaaaattccaaatcctgcttacaagggaccctggaaggctaagaaaatcaagaatcctaattataaaggaaaatggaagatcccttatattgataatcctgaatttgaagacgatcctgatctatatgttcttaagccaatcaagtatgttggcattgaagtttggcaggtgaaagctggctctgtttttgacaacattctgatttctgacgatcccgactatgcaaagaatgtggtgaacgaagtatttgctaatagggaggctgaaaaagaagcctttgaggaggcggagaaagtgagaaaagccaaggaggacgaggaagctcagagagcaagagaagaaggtgaaaggaggagaagagaaaggggtgacgatagaaggcatcgagacagggagcgccatagggacagatacagaaagcaccgacgtgattatatggatgacgactatcatgatgaactttaaaactgagatattgttccgtaaactcgtttacggcgttgacttgaaattccgacgacagcaatttgtatcgtaatgtgtcatttgagatcggaacaagaaattaaactctgcttgaattgaaaactggtttggtatgcaattgtattttaagaattgtcttggtttctgtctattaatgaaatattgggagaccatttttctgcta

SEQ ID NO: 913 - DNA, 1784 bp, Triphysaria versicolor
tacaaaagttattcggagctttttttctactgtttttttttgtcatggcgaggaagatgcttatcgatggtgagctcgacaaaaccaatgaggtggagagtcattatgacttcgatctatttgtaattggggctggaagtggcggtgttcgcgccggtcgtttttcagcgcaaaacggagctaaggttggtatctgcgagcttccgtttcatcccgtcagctctgaagttattggcggtgttggcggaacttgtgtcattcgtggttgtgttccaaaaaagattttggtctatggtgcttcttatgggcctgaactggaggatgcaaggaattatgggtgggaactgaacgagagaaatgatttcaattggaagaaactcctgaaaaagaagactgaagaaatagttagattaaatgggatatacaagcggctactttcaaatgcaggagttaagttatatgaaggagaagggagagttgttggtccaaatgaagtcgaattgattcagttggatggaacgaaaattaactactcggcaaaaaacattctaattgcaactggtagccgggctcagcgtccacctattccaggccaggagttagccatcacttcagatgaggcattgagcttggaagagttacctaagcgagctgttgtacttggtggagggtatattgcggttgagtttgcttctatttggcgagggatgggttcgacagtggatttgtgtttcagaaaagaacttcctttgagaggttttgatgatgagatgcgagcagcagttgcaagaaatcttgaagggargggtattaacctgcatcctaggacaaccttaactgagctggttaaaacggaacatggtataraagttcgcaccgaccatggtgaagaaattgtggctgatgttgtactctttrccactggtaggrctcctaacactaaaagattaaacctcgaagctgttggtgttgagcttgacaagacaggagctgttaaggttgatggatattctcgtaccaacatacccagcatatgggccataggtgatgttacaaaccggatgaatcttactcctgttgccttaatggaaggaacctgctttgcaaaaactgtttttggtggagagcctactgagcctgattatggtcatattccttgtgctgtgttctgcataccaccactctctgtggttggtctcagcgaggaacaagctatagagcaagcaaacggcgaccttttggttttcacatcatcgtttaatccaatgaagaacacaatttctggacgaacagagaaaacggttatgaagcttgttgttgatgctgagactgacaaagttatcggagcatccatgtgtgggccagattcacctgagatcatgcagggcattgctattgcactcaaatgtggagctaccaaagcacagttcgacagtacagttggtattcacccttctgctgctgaggaatttgtgacgatgcggacggtgagtaggcgaattgcagcagctggtaaaccaaagaccaacctgtagactttgaagtgtgatagtatttcataattggacaactatttagtttatacgcaaataaatattcttatgtttgcttttgtctcaaagttgtttgctgagaacttaaaaatatgtagaattttacggaactgcgtaaaagaaattgctaaattaaactaccaattgcaaattgtttgctcattgtattttgggaagtcgatttgttaaagattatacgcaatattttagaaattgatcaattgttttcca

SEQ ID NO: 914 - DNA, 1193 bp, Triphysaria versicolor
atggtttgagaaagaaaggtatctttttaaaagagttttaagagaaagatgagtttccaggatctagaatcaggtcgtggagtcgggttgcgaagggggtacgtgaatgggaagcaggatccgactcaggccgtggcctccggaatatttcagatcaacacggcggtttccacattccatcgtcttgttaataccctcggtacccccaargacacgccagagctccgcgagaagctgcataaaactcggctacatattgggcagttggtgaaggatacttctgctaaacttaagcaggctagtgaaaccgatcataatattgwagtcagtgcaagcaagaaaattacagatgccaaacttgcaaaagactttcaagcagtactaaaggagtttcagaaggctcagcggcttgcggctgaaagggaaactgcttatactccttttgtcccccaatctgtccttccttctagcagctattcagctggtgatgtagacataagtacagacaagaatccagaacaacgagctcttcttgtggaatctagaaggcaggaggtcgtgcttttagrcaatgagattgctttcaatgaggccatcatagaggaaagagatcaaggaattcaagaaatacaacaacaaattggtgaagttaatgagattttcaaagaccttgctgtactggtccatgagcagggaactatgattgatgacattggctccaacatcgagggttctcatgcagcaaccgcccaagcaaaatcacaactcgttaaagcatctaaaacccaaagatcaaattcatctctgacttgcttgttactcgtgattttcggcattgttcttctcattgtgatcattgtacttgccgcctgataaggagatcaatcttctcaaagtaaagggagaatcgagaaaagatggttcatgaatagaatcgagaaaaggtggttyaagtttgggtttgtgactgtttgaagcgtgttgcgtcattatcgaaggctgcgtgacaaaagcttatatagttgaatatggwtttgttgatagttgaaggcttgctattggtattatgtatgtaaattgtcatttctggtttcttgttgggttgcttgatgtggattaacttttaaactctttacttccggttaattgtgttcattgtcatgaatgattctttattaaacaaaggttcacta

SEQ ID NO: 915 - DNA, 1110 bp, Triticum aestivum
  misc_feature (1019)..(1019): n is a, c, g, or t
  misc_feature (1054)..(1054): n is a, c, g, or t
  misc_feature (1065)..(1065): n is a, c, g, or t
  misc_feature (1106)..(1106): n is a, c, g, or t
gcacgaggccgcgactagccgacgagctctacttcccccttccggccttgggcgaccgtgacgagcgacgacgaccacggcgacgatggccgcttcctccctctgccacgggcacctgctcctgttcctcctcgtggccgtcgcgtcggcctgcctcggcaccgcggcagcgcatcaagccggatctggagaggggtacacgatcgccggccgcgtcaagatcgatggtgcgagtgcgaagggctttggtcttccagccaagacatcaaacacaaaagtgatacttaatggcggccagagggttacatttgccaggccggatggttactttgcattccacaacgtgccagctggaactcatctgattgaggtctcctcaattggttacttcttttccccagttcgagtagatatcagtgcaaggaatcctggttatattcaagcagcattgactgaaaccagaagagttctaaatgagcttgttcttgaacctctaaaagaagagcagtactatgaggttagggagcctttctctgtcatgtcacttttgaagagtcccatggggttgatggttggttttatggtcttaatggtcttcgtgatgcccaagttgatggagaacatagatcccgaggagatgaagcaagctcaagaacaaatgaggaacaaccccgtatcattctctggcttgctatccagagcgcagggctagaagtagagcatgaggatactgcaaaggtctatatactctataatgtgaktaagagcactattaaagtgcttggcacgtcactcactcggggcaatttcctggggataagaaggaaatcctttccccctgtttttaccgtattttagggctagtttggggaacaccaatttcctaaaagatttatattttcccatgggaaaatgaactaattcccttgggaaaataaaatcttttgggaattggggttccaaactagcccttaattgtaattgtctgccgtgtaaaccttctgaaacctctgaactantgatcgtcaaattgagatatttggtcaatgttgcngttgaacaagngaaccttgacacctgctaacacacagacacgggggcggggncaaa

SEQ ID NO: 916 - DNA, 1854 bp, Triticum aestivum
tccatccgtccatcctctaatcccgtagcagccagcgtagcctagccgcccccacctgctctcctctgctccgggatccatccgtccacccaggccgtcgtcgacctagggttttgtgcagaccatggcgcggaagatgctcaaggacggggaggcgcccgccgtcgccgacgccgacggcggcgggggcgaggggagctacgactacgacctcttcgtcatcggcgccggcagcggcggcgtccgcggctcccgcaccgccgcgggattcggggccaaggttgcgatctgcgagctcccgttccaccccatcagctccgagtggctgggaggacacggcggaacgtgcgtcatacgtggctgtgtcccgaagaagattctcgtctacggggcatctttccggggggaattcgatgacgccaagcaattcgggtgggagatcaacggggacatcaactacaactggaaaaagttgctggaaaacaagactcaagaaattgtgagattaaacggagtgtacaagagaatccttggtggttctggcgtgacgatgatcgaaggggcagggagtatagttgatgctcataccgttgaagtcacccagccagatggttcaaagcaaaggcacacgaccaagcacatattgattgcaactggtagccgggcaactctggtcgacattcctggaaaggagctggctattacttcagatgaggctttaagtttggaggagctaccgaaacgtgctgtgattcttggtggcggatatattgctgttgaatttgcttctatctggaaggggttgggtgctgaagtagatctattttataggaaagaacttcctctaaggggttttgatgatgagatgagaacagttgttgcaagtaaccttgaaggaaggggaatccgattgcatccagggacaaatttgaccgagttgagtaaaacagccgatggcattaaagttgtgacagataagggggatgagctcattgcagatgttgttctttttgctacaggtcgtgcgccgaactccaataggctgaacctggaagctgttggtgttgaggttgatcaaataggagccatcaaggttgatgaatactcccgtacatcagttccaagtatatgggctgtgggtgatgtaacaaatcggattaacctaacacctgttgctctgatggaggctacttgcttcgctaaaactgtatttggtggccagacagttaagcctgattataaagatgtaccttgtgctgttttctgcattccaccgctatctgtagtcggtctcagcgaacaagaggctttggcggaagccaagaatgatcttcttgtttacacatcaagtttcaacccaatgaagaacagcatatccaaacgcgtggagaagtctaccatgaaactggtggttgatgctgagaccgataaggttctcggagcagccatgtgtggaccagatgcagctgaaattatgcagggcattgctgttgcgctcaaggctggagctaccaaggcgaccttcgacagcaccgtcggcatccacccttctgcggcggaggagtttgtgacgatgcggaccttgaccaggcgcgtgagcccgccatccaagccaaagacgaacttgtaagcaagttgcctgcaatgttttggaccaaaattatacgggtgtggccacgggaactgtagacacagactcttgtttcagtttgctagccctgctcttggcatttgacctgaaagtgtgatacggtgtatttgatgatgatagaaataagtttctgtggaacagtttgtacagaaatcctgggtgttgtcatgatttccaacccaaataagcccttgatgttgaaa

SEQ ID NO: 917 - DNA, 1014 bp, Triticum aestivum
  misc_feature (8)..(8): n is a, c, g, or t
cggcacgnggctcgttgtcattattgatcttcgtcctggtcgccctcccttcgcctgcgctcgcacagcagcagccccgccgctccctccggcacgccgtcgtccatcccgctcccggcgcccgcaaatccgtcctcccccctcgacatggcgtcctgcccgtcggtcaagaacatcctcgtgctggacgcggaggggaagcgcgtggccgtcaagtactacgccgacgactggccctccgcgtcctccaagctggctttcgagaagtcgctcttcgtgaagacccagaagaccagcgccagaacagaggctgatgtggtaatgtttgatggctacattattgtgtacaagttcatccaagatctccatttttttgtaactggaggagatgaggagaatgagctcattttagcgtcagttcttcaggggttttctgatgctgttggcattcttctcagaaacagtgtagacaaaaggaccgcacttgaaaatctggatctcatctttttgtgccttgacgaggttgttgatggagggattgttctggaaacagatggaaatgtgatagccgagaaggtgtcaggccatggattggaaggagctgggtcattcactgagcagacgataagccaagccctagcgacagcaagagagcacttcgcgaggtctcttctgaagtagtgtgtgtaggcatctttcgggttggcgatgcacccagcattgaactcctgtgtttcctcttctagcacagtgcacctagtttgcaagaaagaaagaacgagaaaatgacttgatctttgcgtgtgagttcgttcgtctgttgttgtggtgctcgtcgacattttgtcgcagagatgtatgtgcggcctaagtgcctatctggttaccagattcccttctaaggtctgtataagaaacttgtgatggtgcagtcgttggtcytgttgtctcaactctcttttggggcataataacaatccagcagcagcccatgatgctaccaaaaaaaaaaaa

SEQ ID NO: 918 - DNA, 1362 bp, Triticum aestivum
cacagccgcggcctgcgcgtcctccctcctcgcgccgccctccgcctcgtgcgcggggccggccgcgtccggcgcgctcttccccacctccgtgccctcgctgcgcgcgtacccgcggctcctgctcgcgttccgccgccccgccgcggccgccgtcgccgacccgcagggcgccgccgtgctagaggaggaggaggacgaggcgcccgtacagttcgacgacgtcgacgaggattacgaggacggctacggtggccgcggccccgcgttcacggcccccacccgcccgcgcaccggcaaggccgccctcccgctcaagcgcgaccgcacgaggtccaagagatacctggagatacagaagctgagggagagcaagaaggagtacgacgtgcccatggccatctcgctcatgaagcaggtcgccaacacccgcttcgtcgagtccgcggaggcgcatttccgcatgaacctcgaccccaagtacaacgaccagcagctccgggccacggtcaatttgcccaaggggacgggacagaccgtgaaaattgcagttctcacccaaggtgagaagatagatgaggcaagggctgcaggcgctgatattgttggctcagatgacttgattgaacaaataaaaggaggattcatggagtttgacaaattgattgcgtcacctgatatgatgcctaaggttgccagcttgggtaagattctaggaccaagaggattgatgcccaaccccaaagctggtactgtttctccaaacattactcaggctatcgatgagttcaagaaaggtaaagttgaattcagagttgataagacagggattgcgcacattcctttcggcaaggttaacttccctgaagaagaccttattgcaaacttcatggctgttgttcgctccattgagaggaacaagccatctggtgcaaaggggatatactggaaaacggcatatgtatgctcatcaatgggaccttcaatcaagctgaacattaaagaaatgctcgactatggcgcagattcgtctaactagatgtcaccacgaccaattaagtcatcaggcatttgctgccaacttcacaggcttgaccatccatcccttgtgataaatacacactgagaaacacgactgtgggggaacactgggaggtgcttaggtacagtttttttttagtttcacggacatccgacgtcggcagttaaacagtgccctgatcaacaaacaagcggtattgttggtcgtttgtatttatgagcgaattatgcatgcacttacacatgtatttttgtctgatgtttgttgtaatgttcatcattttgtcaatagtcatccttgagcttcagccaaaaaaaaaa

SEQ ID NO: 919 - DNA, 717 bp, Triticum aestivum
tcccaccttcccttcttcctcgcagcagccttatcacttctccggctcaccctagcaaagcgttctccggccagcgagaaagaaagagagcggaggcatgaagatccagtgcgactcgtgcggcgtcgcggcggccacggtggtgtgctgcgccgacgaggcggcgctgtgcgcgcgctgcgacgtggacatccacgccgccaacaagctcgccagcaagcaccagaggctcccgctcgacgcgctcggcgccaagctcccgcgctgcgacatctgccaggagaaggccgccttcatcttctgcgtcgaggacagggcgctcttctgccgcgactgcgacgagcccatccacgtccccggcacgctctccgggaaccaccagcgctacctcgccaccggcatccgcgtcggcctcggccccgtctccgcctgcgccgccggggaccacggcgccagccacgacgccgaccaccccgccccgcccaagctcgcctgcgagccccagccgccggcccagcccgccgccagcgcgcagcaggtcccctcgccgccacagttcctgccgcaggactggggcgtcgacgagctcctgcagttctcggactacgagtccagcgacaagctgcacaaggactcggctctcggcttcaaggagctggagtggtcaccgcggacatgaagctcttccaaaatcacgcgcccaagggcggcagggcg

SEQ ID NO: 920 - DNA, 881 bp, Triticum aestivum
  misc_feature (46)..(46): n is a, c, g, or t
  misc_feature (61)..(61): n is a, c, g, or t
cttgtggcagtgtttgtattcggaaataccttgaagacgatttttngaggcaataatcttnttattcgtgatgcatcctttygacgtcggygaccgctgtgaaattgaagaggttcaggtcgttgtggaggaaatgaatatcatgacaacratctttcttcgttaygataayttgaagatctattayccaaacagtgtgttggccaccaaaccaatttttaatttctacaggagtcctgatatgggagaaggagttgacttctctgtccatgttgccaccccgctggaaaaactggcgctcatgaaggaaagaatactacgttacattgacagtaagaaggaacattggtaccccggtgcgatggttgtcctccgggatgtagatgacaccaacaagctaaaagtgtccatatggctccgacacacactcaactttcaggacatggggatgaggttcgtgaggagggarctcgtgctccaagagatgatcagagtcttgaaggacctcaatattgagtaccggatgttgccccttgacgtgaacgtgcgaaacgcgccccctctgcaatccacaaggatgccgacgacatggaattattcatgaagtggcggggaatcccgttatgataccacatatacaacaattaccgtctctatgctgtggtgagaactggtwrcaactatagccagtagctaattgagctgtcagtgtgcatgcagctgcggcgaccattgtaagagtgtgttgtgtggtatcaaaagctttaatacactcsaagatwggcatacakatagtggccktyaaaatattgaaagcagtcaactatatagacaragcaatgctacacttacggtttgacgattacagattaatgtggtta

SEQ ID NO: 921 - DNA, 1082 bp, Triticum aestivum
ctgcctcgccgccgccgggaaccacatccagccgaatccccctcagctcctccccgccgccgccgtcgtccaccaccagctctcgacgggatgggttcggggagccgcgcggcgtcgtgcctgtgctgcccgttcaagtgcctggcgtgcggcctcttcagctgcctctgcagcatcctcgtctcgctcctcgtcaccgcgggggtcctcgccctcatcctctacttcatcttccgcccgcagatgatcgccgccaccgtcgactcggcctccctcgcccagttcgcgctcggcaccccggccagcccggccctgctccagtacaacctcacgctcgccatgacggtgcgcaaccccaacaagcgggtggggctctactacgacaacgtcgaggcgctcgcgctctacgacggccagcgcttcgggttcgcgcccctcgaccccttcttccagggccaccaggcgtccacggaggtgaagccggcgttcggcggccagcaggtgctggagggggacgtgacccagagcaacctcaggacgcagctgtcgggaggcgcggtggaggtggaggtgaagctcaacgccaagctccgcgtcaaggtgtgggcgttcaaggtgcccgggccccgcgccaggatcagctgcccgctctccctccccgcccccgccgccgccggcgcgcccgccttcaagcccaccgagtgcaaggtctggttctgattccgccgtcgattcgattcgattccttggtgcgcgcggtgcgtttggggatctcatctcatctcttctcttctctcgattcgattggttggttgcgggatgctgctgctctgcgtcgccgccgtggtccgtccattagcatgtagatcttggtagtagagattttcgcacctggtactgccttgttagctttgcacatactatcgatcggtcgattactgttcttttggttctttgttagcaggagtactatccaccgtatactattactactagttgttgcgtatatcggttatattgggatccatcctactattcgaccattgttgatatattcatcgatattcagatttctttcgttc

SEQ ID NO: 922 - DNA, 742 bp, Triticum aestivum
ctcgtgccgaattcggcacgagctcggctggtagccactacctactcctcttctccggtgagccaccggcgatgggtagcagccgccggcggggcgaccgccagctcctgcaccgcctcctcgcgctctcgtcgctgctcctgctcgcctccggggaggtcatcttcgaggagcgattcgaagatggttgggagactcggtgggtgaaatccgattggaaaaggagcgaagggaaagccggtacattcaagcacacggcaggaaaatattccggagatcctgatgacaaaggcattcaaacaacaatagatgctaggcattttgctatctcagccaagataccggagttcagtaacaagggccgaacattggtggtccagtattccataaagtttgagcaggaaattgaatgtggtggcggctatattaagctaatgtctggttatgtcaaccagaagaaatatagcggagacactccatacagcttgatgtttgggccagatatatgtgggactcaaacaaagaagctgcatcttatactctcttaccaggggcagaactaccctatcaagaaagatctacaatgcgaaaccgacaggctgacgcatgtttacacattcattcttaggcccgacgcatcttatagtttacttgttgataaccgtgaaagagaatctgggagcatgtacactgattgggacatcttgcctcctcgaaaaattaaggatgttggtgccaaaaa

SEQ ID NO: 923 - DNA, 1168 bp, Triticum aestivum
atcccctactkatatcccacccgcccgsctcgccacaaatcacccaaatccaatccaccaggccaccaattccccactctcgccgtcaaatctccctcagctcctcctcgccgcccaccaccagctcgacgggatgggttcggggagccgcgcggcgtcgtgcctgtgctgcccgttcaagtgcctggcgtgcggcctcttcagctgcctctgcagcatcctcgtctcgctcctcgtcaccgcgggggtcctcgccctcatcctctacttcgtcttccgcccgcagatgatcgccgccaccgtcgactccgcctccctcgcccagttcgcgctcggcacccccgccagcccggccctgctccagtacaacctcacgctcgccatgacggtgcgcaaccccaacaagcgggtggggctctactacgacggcgtcgaggcgctggccctcttcgacggccagcgcttcgggttcgcgcccctcgaccccttcttccagggccaccaggcgtccaccgaggtcaagccggcgttcggcggccagcaggtgctcgagggggacgtcacccaggctaacctcaggacgcagctggcgggcggcgcggtggaggtggaggtgaagctcaacgccaagctccgcgtcaaggtgtgggcgttcaaggtgcccgggccccgcgccaggatcagctgcccgctctccctccccgtccctgccgccgcgaacgcccccgccttcaagcccaccgagtgcaaagtctggttctgattctccaccatcaattcgattcgattccttggtgcgtgcggtgcgttgggggatctgatctcatctctcgattcgattcgattggttggttggttggttgcgggatgctgctgctctgcgtcgccgccgtggtccgtccattagtatctagatcttgctagagattttcgcatctactgcatcgttagctttgcacatactatcgatccgtcgattactggttttttggttctttgctagcaggagtagtacccaccgtatacgattactagttgttgcgtatattggttatattgggattcatcctactattcgaccattgttgatatactcatcgatattcagatctctttcattcagactctgctgttggattgtgtctgttgatatattcatgctcgttcg

SEQ ID NO: 924 - DNA, 1386 bp, Triticum aestivum
cgaggccccccgccatggcacagccgcggcctgcgcgtcctccctcctcgcgccgccctccgcctcgtgcgcggcggggccggccgcgtccggcgcgctcttccccacctccgtgccctcgctgcgcgcgtacccgcggctgctcctcgccttccgccgccccgccgcggccgccgtcgccgacccgcagggcgccgccgtgctagaggaggaggaggacgaggcgcccgtccagttcgacgacatcgacgaggactacgaggatggatacggcgggcgcggccccgcgttcacggcccccacccgcccgcgcaccggcaaggccgctctcccgctcaagcgcgaccgcaccaggtccaagagatacctggagatacagaagctgagggagagcaagaaggagtacgacgtgcccatggccatctcgctcatgaagcaggtcgccaacacccgcttcgtcgagtccgcggaggcgcatttccgcatgaacctcgaccccaagtacaaygaccagcagctccgggccacggtcaatttgcccaaggggacgggacagaccgtgaaaattgcagttctcacccaaggtgagaagatagatgaggcaagggctgcaggcgctgatattgttggctcagatgacttgattgaacaaataaaaggaggattcatggagtttgacaaattgattgcgtcacctgatatgatgcctaaggttgccagcttgggtaagattctaggaccaagaggattgatgcccaaccccaaagctggtactgtttctccaaacattactcaggctatcgatgagttcaagaaaggtaaagttgaattcagagttgataagacagggattgcacatattcctttcggcaaggttaacttccctgaagaagaccttattgcaaacttcatggcagttgttcgctctattgagaggaacaagccatctggtgcaaaggggatatactggaaaacggcatatgtatgctcatcaatgggaccttcaatcaagctaaacataaaagaaatgctcgactatggcgctgattcgtctaactagatgtcaccacgagcaccaattaagtcatcaggcatttgctaccaacttcacaggcttgactatccatcccttgtgataaatacacaccgagaaacacgactgtgggggaacactgggaggtgcttaggtacagtttttttttagtttcacggacatccgacgtcagcagttaaacagtgccctgatcaacaaacgggcggtattgttggtcgtttgtatttatgagcaaattatgcatgcacttacagatgtatttttgtctgatgtttgttgtaatgttcatcattttgtcaatagtcatccttgagcttcagccaaaaaaaaaa

SEQ ID NO: 925 - DNA, 415 bp, Triticum aestivum
tagaatatccaaacttcgattgaatcacaakgtgragawttccaacaccatgaaagagcaactgaaagaaagcaggattaagatcttagctaccttgctggtctttgccatggttaccgaaggcttggcgattcgtgtcaatgggacggtgaggaatgacatcaccggtgagggtgtcagcacaaaaaccaccctgggtgcaggcagcagcacaaccgtggacaaccaccatgcaatcccacgggaccagtatagtagccatggaggagaggatggatcagatggcagtggtggtgatactacaaagaactagtgccattctctgagactgttctgttcaccgaagatttatattcttatctctgatgtcatattgtatagatgccagcagcgctataattattacttttcatgc

SEQ ID NO: 926 - DNA, 1916 bp, Triticum aestivum
ctctaatcccgtagcagccagcgtagccgcccccacctgctctcctctgctccgggatcaatctaccccggccgtcgacctagggttttgtgcaggccatggcgcggaagatgctcaaggacggggaggcgcccgtcgtcgccgacgacggcgggagctacgactacgacctcttcgtcatcggcgccggcagcggcggcgtccgcggctcccgcacagccgccggcttcggggccaaggttgcgatctgcgagctcccgttccaccccatcagctccgagtggctgggaggccacggcggaacgtgcgtgatacgtggctgcgtcccgaagaagatactcgtctacggggcatctttccggggggaattcgatgacgccaagcaattcgggtgggagatcaacggggacatcaactacaactggaaaaagttgctggaaaacaagactcaagagattgtgagattaaatggagtgtacaagagaatccttggtggttctggtgtgaccatgattgaaggggcaggaagtatagttgatgctcatactgtcgaagtcacccaaccagacggttcaaagcaaaggcacacgaccaagcacatattgattgcaactggtagccgggcaactctggtcaacattcctggaaaggagctggctattacttcagatgaggctttaagtttggaggagctaccgaaacgcgccttgattcttggtggcggatatattgctgttgaatttgcttcaatctggaaagggttgggtgctgaagtagatctattttataggaaagagcttcctctaagaggttttgatgatgagatgagaacagttgttgcaagtaaccttgagggaaggggaatcagattgcatccggggaccaatttgactgagttgagtaaaacggccgatggcattaaagttgtgacagataaaggggatgagctcattgcagatgttgttctttttgctacaggtcgtgcgccgaactccaataggctgaacttggaagctgttggtgttgaggttgatcaaataggagccatcaaggttgatgaatactcccgtacatcagttccaagtatatgggccgtgggtgatgtaacaaatcggattaacctaacacctgttgctctgatggaggctacttgcttcgctaaaactgtgtttggtggccagacagttaagcctgattataaagatgtaccttgtgctgttttctgcatcccaccactatctgtcgtcggtctgagcgaacaagaggctttggcggaaaccaagaatgatcttcttatttacacatcaagtttcaacccaatgaagaacagcatatccaaacgcgtggagaagtctaccatgaaactggtggttgatgctgagaccgataaggtacttggtgcagccatgtgtggaccagatgcagctgaaattatgcagggcattgctgttgcgctcaaggctggagctaccaaggcgaccttcgacagcaccgtcgggatccacccttctgccgcggaggagtttgtgacgatgcggaccttgaccaggcgcgtgagcccgccatccaagccgaagacgaacttgtaagcaagatccgtgcaatgttttggaccaaaattataccggtgtggcgaagggaactgtgtacacgtagatgcttgtttcagttcgcgagccctgctgcgcttggcatttgacctgaaagggtgatacggtgtatttgatggtagaaataagtttgtgtggaacagtttgtacagaaatcgtgggtattgtcatgatttccaacccaaataagcccttgaagttgaaatacttccccatttagcctgcatgtcatgccagtacctttttttgaggggtatgtcatggcagtccctgaatattataggctgctcatgtgccttcaggttc

SEQ ID NO: 927 - DNA, 1221 bp, Triticum aestivum
ccacgcgtccgcgcgtctcgtgcctccgacgcaacgcgctctcgtcttgctcccagagccggagcccacccgagccgcgacctccctctcctcctccccgtacacccatggggtcgtcggaggccgacgacgaccagctcctcaagagcttcctggccgaggtcagcgaggccgagcgcgacaacgaagtcctcaggatacttggttgcttcaagttaaacccttttgagcatcttaagttgtcttttgattcttctgtggatgaggtgaagaagcaatataggaagttgtcactgttggtccatcctgacaagtgcaagcatccacaagcacaagaagcttttggagccctggcaaaagcacagcagctcctacttgatccacaggaaagagggtacattcttgatcaagttacttctgcaaaagaagaactgagggcaaaaaggaaaaaagagttgaggaaagacagtgcatccaagataaaatcccaagtagatgagggaaagtatgaagaacagtttgaaagatcggacgaatttcagaagcagctaataattaaagttcgtgagattttgacagacaaagaatggcgtcggaggaaaatgcagatgaggatatcagaggaagaaggaagactgaagaaggacgaggaggaaacaaaagaaatgtggaagaggaagagagagcatgaagagaagtgggaggagacgagagaccagcgagtctctagctggagggatttcatgaagacaggaaagaaggcacggaaaggagagctcaaacctccaaggctcaagactgaagacccgaacaaatcttatgttcagaggccagtaaagcgtggttaaaaggtgtcgtattcatctgcactcgaagaccaatctggcggccattcttgccgcgacctgatccaagccacagcctgtcaagtttatctttcaggctataaacttgagttatggcttgtatgttcccagtgtagtcagtggaacatggcagataactgtgagcaaaaatggccgcatatcatctacatagagtggtattggactaatgtacctgtgtagaatgccttcttgaaaaagaaactttctgttggaaaagaaacgctgaagtggatcttggaatatgatcgttgtttcaatattcactgtaagtcatgcttacatatatgttttcacgatttgctagctatcatagtatgacccctggacttgttgc

SEQ ID NO: 928 - DNA, 933 bp, Triticum aestivum
gaggagagaagagaaagcgaagctcccgtgctcgcgcgacgacgacgacgacgaccccggccgcggcgacgatgagccccctccgcgccctcctcgtcctcgccgccgtcctcgcggcgtgcctcggccccgcggccgcggaccagcccggatccgtcgagggatacaccatcgccggccgcatcaagatcgacgctgcaaggggctttggtcttccagccaagacatcaaacacgaaagtgatacttaatggtggtcagaaagttacattcgccaggccagacggctactttgccttccacaacgtgcctgctgggacacatttgatagaagtctcctcacttggctacttcttttcaccagttcgagtggacatcagtgccaggaatccagggcacattcaagcagcattgactgaaaacagaagagttctaaatgagcttgttttggaacctctgaaagaagagcaatactatgagccgagggagcctttcaacattttgtcccttttgaagagccccatgggtatgatggtcggttttatggtcctaatggtcgtcgttatgcccaagatgatggagaacatagatcccgaggagataaagcaagctcaagagcaaatgaggaactcacctgttccatccttttctggcttgctagccagagcaaacagctagatgtagaacatgtggacaatacgtcgcttaagtttatgatgcgacaaacatccttgccaaactgcttcacactcgagtcatgggaggctgggataaggtggaaactcttttgcccacttttaatgtattctactgtattctaagatgtaataggtttgtaatggagaaccgtctgaaacacctggctgaactagtcatgaaatatttgatttatagctcacgtcgagtacagtgtgtcaacttgttaaccatttga

SEQ ID NO: 929 - DNA, 648 bp, Triticum aestivum
gagcgatctgcactagtcgctgcaagaaccaccaccacaagtgagtgaacgtcggagcaaggaaaggcagggagagatggcaatgaggccgctcgtcgtcctggctctggccgtggcgctggccggggtggcgctgcgagggggcgccgcggagggggccggcgagtgcgggaggtcctcccccgaccggatggccctgcgcatggccccgtgcatctcggcggcggacgagccggactcggcgccctccagcagctgctgctcggcggtgcacaccctagggaagagccccagctgcctgtgcgccgtcatgctgtccggcaccgccaagatggccgggatcaagcccgaggtggccatcaccatccccaagcgctgcaacatggccgaccgccccgtcggctacaagtgcggagattacacgctgccttgatggcccagctctggtgctgatgaagatgaatgctgtggaagatatggtcgtgtgggaataagcgagtggtgcatgtaccacttaagtggggcactagtgactgcatggtgcctacatgtgatgtgtgcttgtgggaatatttctataagcatgtaatgtttcgtctgtgttaacgtgaacacacgtctccgtgtgatttctattgtcaaaaaaaa

SEQ ID NO: 930 - DNA, 1749 bp, Triticum aestivum
ggcgcgctctctctctttctccattgctgcccccttgattctcgcacaggaggccacggctcgcgctctccctggctgacacggcggtgggctgctcaggcgcgtggtgcggcgggcgctggtgtggtttggggctgttgatactgccgtgagctagtgatggcgactgcggtgttcgccggggaggggaccgccgcgcgcggggggtgctcggcggaatgcgccggcgggatcgagaggccgccggatctcgggarcagggcscgtgccgcgggggacgggtgcsctaagaggarcgtktaccttatggagtgcgtgccgctgtggggctkcsccgcggcgcgcggccgcgccgcggagatggaggacgcgtgcgccgccgtgccgcgcttcgcygccstgccggcgcggatgctcgcgagcagccgygagctggacgggatcgggggcgacttcgacgccgccgagctccggcttccggcgcacctgttcggcgtctacgatggacacggcggctcggaggtcgcaaactactgccgggataagatccacgtcgtgttaagagaggtgctgaaagctggcaggtggttggaggaattgggggaagtaggggagctcgacgtgaaagaaccatgggagaaggttttcggtgattgtttccagaaggtagacgacgaggtgtcggggaaagcgagcaggttttccaatggcaccagggagatccgtcctgagcctattgccgctgataacgtgggttccaccgccgttgttgccattgtctgctcttctcatgtcataactgcgaattgtggagattcacgcgtggtgctctgccgtggaaaggagcccattgctctgtccgtcgatcacaaacctgataggaaagatgagcgtgccaggattgaggccgcaggtggraaggtcattgactggaatggttatcgtgtctctggtattctsgcaatgtcacggtcaatcggtgaccgatacctgaaaccatttctgattccaaagccagaagtcagcattgttgctcgggcaaaagatgacgactgcctcattctagcaagcgatggtctctgggatgtcatgtcaaatgaggacgcatgcaaagttgcccggcgacagatccttctgtggtacaagaataataacgacggtgcgaattccgatggaggcagcgaacccactatgaacccagctgcaaaagcagccgctgattgtctcgtgaggctagcgctgtcgaaagggagcggggacaacattagtgtcattgttattgacctgaaatcaagaaagaagaccaagggcaaaacctaacatacccataattcacccgactagctgaccatgtctggagtttcgtccgctagtctgcttcccttgcaagaacggcacacctactttttttgtttcttcagtcgtctgcaagagctgtatgtgtatatgctaataggtctacttccgataatctgatgtatggggtgcgtgttggcgtgtttctgtatacccccttagccttttggttttgggctgttcacacttgattctcatcaggttcagaacagccatgtaaatgtagtggtgtctgcataataattgagccttgtaaaggactgagcagctgatatgatcgtcggaagttacatgtgtagcagaagatgtgcttgcaggtgttgccttcctctgatcatcatatgtaccctgttttacagatcatcagatgaacatgatggatgttgatgaaaa

SEQ ID NO: 931 - DNA, 1194 bp, Triticum aestivum
cccgcgtccggacctcgccgctgcagtcccgctcctcctcgccgtcgccgmcggamycacgctyccgggagccaccagcaccagcagcaccagcaaagcaagccgcctgactcttgcgatgggttcggggagccgcgcggcgtcgtgcctgtgctgcccgttcaagtgcctggcgtgcgggctcttcagctgcctctgcagcatcctcgtctccctcctcgtcaccgcgggggtcctcgccctcatcctctacttcgtcttccgcccgcagatgatcgccgccactgtcgactcggcctccctcgcccagttcgcgctcggcaccccggccagccccgcgctgctccagtacaacctcacgctcgccatgacggtgcgcaaccccaacaagcgggtgggcctctactacgacaacgtcgaggccctcgcgctctacgacggccagcgcttcgggttcgcgcccctcgaccccttcttccagggccaccaggcatccacggaggtgaagccggcgttcggcggccagcaggtgctggagggggacgtgacccagtccaacctcaggacgcagctggcgggaggcgcggtggaggtggaggtgaagctcaacgccaagctccgcgtcaaggtgtgggcgttcaaggtgcccgggccccgcgccaggatcagctgcccgctctccctccccgccgccggcgcccccgcattcaagcccaccgactgcaaagtctggttctgattcgattctccaccattggggaatctgatcttcgattcgattcgatcggttggttgcgggatgctcttgctctgcatcgcccgccgtggtctttctagagattttcactgtctagtagtagtaccagtcgcattttgttggctatatgcacatattatggatcggtggtagagatcaatcgttctttggttctttgttagcagtactactattactactactacctgtgttyggycmcccagaaaacckggtgaartwaaaaratkctaaaawtcggtgggtgccsgmgggggtwactccraaskggwytcymacasggggaaaacccgtggaagcttttgcccgcgagggaagcttgccaaggagtcaggacgttgaaggcttcccgggatcggcgcgcggattattccggtttttgcccccacgacaacgaattaggcggccggggatatcta

SEQ ID NO: 932 - DNA, 1998 bp, Triticum aestivum
caaaacaaacggcataaaccacggcctcgacccgctccgtctccgctccccccacttccagtccacttcccctccgacccacccctcaagcgaaggcaccggatggcggcgtcctcccccacccccggcggcggcctcggggccatcctcgccgccggcgacagggactacctcatccgcaactccggcgagcaggtgaagatcagcagcattgagggagacactgtagctatctatttctcggcctcatggtgcccgccatgccagcggtttacgccaaagcttattgaagcatacaaagaacttacctcacatggcaagagctttgaggtgatctttgtttcaggcgaccaagatgaggaagcattcaatgcctattttgcaaagatgccgtggttggcagttcctttctccgactctgaaggccgtaaaagccttgatgagcggtttgaggtcaacggtattccacaccttgttttccttgatgcaaaaactggcgaagttcttactgatgaaggagttgagtttgtgagtgaatatggaatagaagcttatccttttacaactgagaggatcaatgaattgaaggaacaagaaaaggctgctaaggataaccaaactattcatagtgtgcttgctacaccaaatcgtaactatgtaatttcaaacacgggggagaaggtacccatcgttgatcttgaggggaagtatgttggtatatgctttgtagtgaacggctatcctccagttgaggaatttaccccagtgcttgccaagatatatgcgaaactcaaagaagtgggggagaagtttgaagttgtagctgtatccttggacagtgacgaggaatcattcaataacagtttttcaagcatgccttggctcgccattccccagggcgacaagatgtgtcagaagcttgtcagttactttgagcttagtgatcttcctacactagtgctgattggtcctgatgggaagacactgagcagcaatattgcagacataattaatgagcatggtttggatgcatgggaggggttccccttcaatgcagagaagctggaaattctagcagagaaggcaaaggctaaagcagcgtcacagacattggagtcccttctggttactggtgacgtagactttgtcattgggaaagatggagcaaaggttcctgtagcagaacttgttgggaagactgtcctcctctacttttcagctaaatggtgtgggccatgcagagccttcctgcctacactggtggatgtttacaacaagatcaaggagaagaacagcgatttcgagatcgtcttcatctccagcgacagggaccagagctcattcgacgacttcttctctggcatgccatggctcgccatccccttggaagacgaaaggaaggcgtacctgaaaaagaagttcaagatccgcggaatcccgtctctcgtcgccattggtcctgatggaaagacggtcaacacggacgcgaagacttcgctggcggtccatggcgccgacgcgtttccgttcaccagcgagaggatccaggagctggagaagaagatcgacgagatggcgaaggggtggcctgagaaggtgaagcacgagctgcacgagcacgagctcgtgctgatccgccgccccaggccgtacggctgcgacgggtgcgaagagatgggcacctcctggtcctacaactgcgcggagtgcgacttcgatctgcacgccaagtgcgcgctgggtgaggagaagaagggagaggaggtgaatgggcaggagcatgctgctgccccagctgggtacgtgtgcgagggagacgtctgcaggaaggcctaggtagcgttggcgttgtgtgtgttccttgccagctgaagcgtgtctgaaccatgtgctgtgtggtgtgatgataaataaatcttgcatccgatgatttggcttgggaagtatttgtcgtggtgacatttattatgtgcaaaatcgtccaagtatatggtttca

SEQ ID NO: 933 - DNA, 793 bp, Triticum aestivum
gaacttgaggaacgcgagcgcaagcactactcttccaaggataagtcctattctgaagaaagagaccggcggaaaagctcaagccagctactcttagaaggttcaaagagagaggcagaggataagatagttccacgagaaatcgatgcagatgactctgatgtggagcctaaaagtgatgatgagagtgatgaagatgatgacgacgacgacgacactgaagctctaatggcagagcttgagaggattaagaaagaaagagctgaggagaagcttagaaaggagcggcaacaagcagaagaggaggccaagatgaaggaggctgaactgatgcggggaaaccctttgattaatatcaacaatcctggctccttcagtgttaagagaaggtgggacgatgatgtggttttcaagaaccaagcacgtggagagaccaagacaccgaaacggttcatcaatgataccatcaggagtgatttccaccgtaaatttcttcagaggtacatgaagtgatggtaccgctgtgtacaacttacatgtctccgctccttgtatgggagagcattggttcagttgggagctcttatcgttgttatgtttgtgtacgagtgaaagaccagcatagcattggttcagttgagagctctcatcgtgttaagtttgtgtacgagtgaaaggccattattgtgttgctgtatgaaacaaaagtataaacatctgtcggcatcttaacaaagctgtactgagcaatacatatcttatctgaatgtgccaaggtcctaaaaaaaaaaaa

SEQ ID NO: 934 - DNA, 528 bp, Triticum aestivum
  misc_feature (451)..(451): n is a, c, g, or t
  misc_feature (475)..(475): n is a, c, g, or t
  misc_feature (526)..(526): n is a, c, g, or t
ccgcaaagctgcttcccggactagctagggtttcgtctacgccgcttgatctagtcctctctcccggcacgcgaggtagggcgcagcgttgatggcggcggcaccggcggacgctaaggcggaggccgccaagatggacctcctcgaggacgatgacgagttcgaagagttcgagatcgaccaagaatgggatgaccaggaagaaggcaacgaagccgtccagcagtgggaggatgattgggatgacgatkacgtgaacgatgattctcgctgcagcttaaggaagagctggacggaagcaacggccagaagagctgaagtattatttctctactttatataaatgatttttatatggcagctacttttggaaccgttgatgtgctttggatgtgaaagttttggrcatcaatcsgcaattgacaacactgtacgtgttagttgtcgttangatatgtctctagccgaaacgctngaaccgccacatgtctacgcccaactgttctcttaaaagatgccgcactgntt

SEQ ID NO: 935 - DNA, 1365 bp, Triticum aestivum
cgggtcgacccacgcgtccgagacctgcccgttcgcgaggcgggcggaggttctttagcgtcggccgagatggcggcggcggcggcgatctgcggggaggacgagccggcgccgcgcgatccggagagcgcggcggcggcgggcggcggggtcgagcggctggatctcggggacggccgggcggcgctcgtggcggggggcaagakgagcktctacctcatggactgcgagccggtgtggggctgcgtcrccacgccggggcgcggcggggagatggaggacgcctgcrccgccgtgccccgcttcgccgacgtgcccgtgcgcctgctcgcccggcgccgcgacctcgaagggctcgggctcgacgccgacgcgctccgcctgccctcccacctcttcgccgtcttcgacggccacggcggctccgaggtgtccaactactgccgggagaggctccacgtcgtgctgagcaaggagctgaggaggccccccagcgatctgggcgagatgagcgatgtggacatgaaggagcactgggacgacctcttcaccaggtgcttccagacggtggatgacgaggtgtcagggcttgcaagcaggctcgtccacggacagccccggtcagacccgatcgccgcggagaacgtgggctccacggcggttgcagtggtggtgtgctcctcccatgtcgtggtcgccaactgcggcgattcacgcatcgtgctctcgcgcgggaaggagcctgtcgccctctcaattgatcagaagcctgacaggaaggatgagcgcgccaggattgaggctgcgggaggcaaggtcatccaatggaatggacaccgagtgtccggcatactggctatgtcacgatccattggtgaccgatacttgaagccatacatcatcccaaaaccagaagttacgattgttccccgggctaaagatgacgactgcctcattctggccagcgacgggctttgggacgtcgtgtcaaacgaagaggcgtgcaaggtcgcgcgccggcaaatccagcagtggcacaagaacaacagcgtcacaacatcgtcatcagatggaggtgatggatccaccgaccctgccgcgcaggcagctgcggactatctgacgaggcttgcgctgaagaaaggaagccaagacaatataaccgtaatcgtggtcgacttgaaaccccggaggaaacccaagaataattcctaacataacttgaattcatactagcagttggtcttctaatgagacttgacccacctttttcgttgggtttcaagaattgtacatgtatatgatagatggttttcgacctagtgggttataaagattaattaatttatcccctttttctgttca

SEQ ID NO: 936 - DNA, 1055 bp, Triticum aestivum
ggggaaaaaagagggatctctctctctctctctctctctctactcctctgtgcgcttgccattttccccaaatctgttagagagagagagagagagagagctaggttttccctgcgctcgagcgatccagcaggagcggccatgaacatcttcaagaagaaggtcgaccccaaagaggctctcaggacgagcaagcgagagatgtcagtcgccacaagaggagttgagcgagagattggctccctgcaaatggaggagaagaagctggttgctgagatcaagaagactgccaagactggaaatgaggctgcaaccaaaattctagcccggcaactagtcaggcttaggcaacaaatcgtcaatttacaaggtacacgggcgcagatacgtggagtagctactcacacacaggcaatgtatgctggaacttcaatatctgctggaatgaaaggcgcaagcaaagcgatggcagcaatgaataagcaattggaaccaacgaagcagatgaagcagatgagagaattccagaagcaatcatctcaattggacatgacgcttgagatgatgtctgatgccatcgatgaaacactagataaggatgaggctgaagaggaaacagaagagctcacgaaccaggttctggatgagattggtgttgatgtggcttctcagctgtcttctgcacctaaaggccgtattggagccagtaacaagaaagccgagaacaaccaagcacggaatgcggctccagcgaaaaatgtggcgcctgaacctaatgccgctgaagttgatgatctggagaggagactggcatctctccgccgcatctgagttgctgctgcaagaaagtttatatagccttatatatgtaaatctgtttactggtgccttgtttccaaattctggtagcttaatattgtaaccaggaaacaagctagtacatgtgacttaatagaacctgagttttctgtttggtgtagcataaactgtcstgttgccaatcraatgtggctgaaaagaaatatggtggagcataaawwawttatgaagtgaac

SEQ ID NO: 937 - DNA, 1122 bp, Triticum aestivum
tggacgtgaaggaaccatgggagaaggttttcggtgattgtttccagaaggtagacgacgaggtgtcggggaaagcgagcaggctttccaatggccgtccggagcctattgccgctgataacgtgggttccaccgccgttgttgcgattgtctgctcttctcatgtcataactgcgaattgcggagattcacgcgtggtcctctgccgtgggaaggagccgattgctctgtccgtcgatcacaaacctgataggaaagatgagcgtgccaggattgaggccgcaggtggaaaggtcattgactggaatggttatcgtgtctctggtattctcgcaatgtcacggtcaatcggtgaccgatacttgaaaccatttctgattccaaagccagaagtcagcattgttgctcgggcaaaagatgacgactgcctcattctagcaagcgatggtctctgggatgtcatgtcaaatgaggacgcatgcaaagttgcccggcgacagatccttctgtggtacaagaataataacgacggtgcgaattctgatggaggcagcgaacctactatgaaccctgctgcaaaagcagccgctgattgtctcgtgaggctagcgctgtcgaaagggagcggggacaacattagtgtcattgttattgacctgaaatcaagaaagaagcccaagggcaaatcataacatgtccataatccacctgactagctgaccgtgtctgcgaccggagtttcgtccgctagtctgctttccttgcaagaacggcacgcctactttttgtttcttcagtcgtctgcaagagctgtatgtgtatatgctaataggtctacttccgataatctgatgtctggggtgtgtgttggcgtgtttcggtatacccccttagccttttggtttcgggctgttcacatttgattctcatcaggttcagaacagccatgtaaatgtagtggtgtctgcataataattgagccttgtaaaggactgagcagctgatatgatcgtcggaagttacatatgtagcaaaagatgtgcttgcaggtgttgctcttctcagatcatcgtatgtagtacttttcttccagatcatcagatgacatgatggatgttgatg

SEQ ID NO: 938 - DNA, 916 bp, Triticum aestivum
agacggtggagaggagagaagagaagagaagctctcgtgctcgcgagacgacgacgacctccgccgcggcgacgatgagccccctccgcgccctcctcgtcctcgccgccgtcctggcagcgtgcctcggccccgcggcggcggatcagccaggatccgtcgagggatacaccatcgccggccgcatcaagatcgacgctgcaaggggctttggtcttccagccaagacatcaaacacgaaagtgatacttaatggtggtcagaaagttacattcgccaggccagacggctactttgccttccacaacgtgcctgctgggacacatttgatcgaagtctcctcacttggctacttcttttcaccagttcgagtggacattagtgccaggaatcctgggcacattcaagcagcattgactgaaaacagaagagttctaaatgagcttgttttggaacctctgaaagaagagcaatactatgagccgagggagcctttcaacattttgtcccttttgaagagccccatgggtatgatggtcggttttatggtcctaatggtcgtcgttatgcccaagatgatggagaacatagatcctgaggagataaagcaagctcaagagcaaatgaggaactcacctgttccatccttttctggcttgctagctagagcaaacagctagatgtagaacgtgggacagtatgtggcttaagtttatgatgcgacaaacatccgtgccagactgcttcacacttccatgggaggctgggacaaggtggaaactcttttgcccacttttaatgtattctactgtattctaagatgtaataggtttgtaatggaaaaccttgtgaaacacctggctgaactagtcatgaattatttgatttatatagctcacgtcaagtacagtgtgtc

SEQ ID NO: 939 - DNA, 945 bp, Triticum aestivum
gagaagctctcgtgctcgcgagacgacgacgacctccgccgcggcgacgatgagccccctccgcgccctcctcgtcctcgccgccgtcctggcagcgtgcctcggccccgcggcggcggatcagccaggatccgtcgagggatacaccatcgccggccgcatcaagatcgacgctgcaaggggctttggtcttccagccaagacatcaaacacgaaagtgatacttaatggtggtcagaaagttacattcgccaggccagacggctactttgccttccacaacgtgcctgctgggacacatttgatcgaagtctcctcacttggttacttcttttcacctgttcgagtggacatcagtgccaggaatccagggcacattcaagcagcattgactgaaaacagaagagttctaaatgagcttgttttggaacctctgaaagaagagcaatactatgagccgagggagcctttcaacattttgtcccttttgaagagccccatgggtatgatggtcggttttatggtcctaatggtcgtcgttatgcccaagatgatggagaacatagatcccgaggagataaagcaagctcaagagcaaatgaggaactcacctgttccatccttttctggcttgctagccagagcaaacagctagatgtagaacatgccggcaatatgtggtttaagtttatgatgcgacaaacatccgttccgaactgcttcacactcgagtcagaatgttgttccatgggaagctgggacaaggtggaaactcgtttgcccacttttaatgtattctactgtattctaagatgtaataggtttgtaatggagaaccgtctgaaacacctggctgaactagccatgaattatttgatttatagatcacgtcgagtacagtgtgtcaacttgttaaccatttaatattggatgccttggtgagtc

SEQ ID NO: 940 - DNA, 1162 bp, Triticum aestivum
agcacaccaatctactcctacctcgccgtcgccggaaatcccatccagccgaaccacccctcaggtcctccccgccgccgccgtcgtcgtccaccaccagctcgccaggatgggttcggggagccgcgcggcgtcgtgcctgtgctgcccgttcaagtgcctggcgtgcggcctcttcagctgcctctgcagcatcctcgtctccctcctcgtcaccgcgggggtcctcgccctcatcctctacttcatcttccgcccgcagatgatcgccgccaccgtcgactccgcctccctcgcccagttcgcgctcggcaccccggccagcccggcgctgctccagtataacctcacgctcgccatgaccgtgcgcaaccccaacaagcgggtggggctctactacgacaacgtcgaggccctggccctcttcgacggccagcgcttcgggttcgcgcccctcgaccccttcttccagggccaccaggcgtccaccgaggtcaagccggcgttcggcggccagcaggtgctggagggggacgtcacccagagcaacctcaggtcgcagctggcgggcggcgcggtggaggtggaggtgaagctcaacgccaagctccgcgtcaaggtgtgggccttcaaggtgcccgggcccagggccaggatcagctgcccgctctccctccccgccccaggcgccgccgccggcgcccccgcgttcaagcgcaccgagtgcaaagtctggttctgattctgattccgattgcgattgcgccgttggggatcgatctgatctgatctcttctctagattcgattatttggttggttggttggttgcgggatgctgctgctctgcgtcgccgccatggtctgtccattagcatgtagatcttgctagtagagattttcgcatctagtactgcattagtattagctttgcacatactatcgatctgtcgattactggttttttggttttttgttatcaggagtactaccgtatacgattactagttcttgcgtatattggttatattgggatccatcctactattcgaccattgttgatatattcatcatcgatattcagatttctttcattcagactctgctgttgacttgtactactatctgcgttgatatattcattcatgctcggggttcatcag

SEQ ID NO: 941 - DNA, 1567 bp, Triticum aestivum
  misc_feature (1531)..(1531): n is a, c, g, or t
tcattgttcaaccaatatgtcactgacacgctctcggggccgcaactagttgaagaacaaggccccatgtttgctgagccgagtgatctccatgccgcgatgccaaccaagaatctatcggggctaaggagctttccgccatcggtttcaatgtctaagcagcagggccaaggaagcaagcaactatccaaggagaaaagacagcatcagattgatgaagggataagcattgacaagctccataagctcaatcggagcaacgtctcagcctggaacatgaaaaggttgatgaagattattcggtctgggacgctcaccactatagatgagcagataaagcaggcaacaggagaaggggatttgtcagcgacacatattcgcagcgaatacgagtcacaatggccgcaaagaagatcttccataacgtagccaagcatcgatccaagtacatatacttagcagacttgatgcacttcatgaggcaggaggaagccatcaaagcaatgcatcttttcgaaggaggacaagagtacaataggatcagcaagaggtctctaaaaaactggatggtgaatgcatttaragagcgcaaagcccttgctctaacacttaatgatacaaaagttgcagtatccaagctcaaccagatgactaatgtagttggtggcatcatcgtgtttgttctctggctccttattcttggcatagcgacaacgaatttacttgtcttcctcagttcaccatttttggtggcagttattgtatttggagayactttgaaggcagtttttgaggcaattgttttcttatttgtgatgcatccttttgatgttggtgaccgctgtgaaatcgaggaagttcaggttgttgtcgaggaaatgaatatcttgacaacagtcttycttcgatatgacaacctgaagatatattatccaaacaatrtactggccaccataccgattatgaatttttacaggagtccagatatgggagaaggaattgacttctatattcacgttgccacrccggtagcgaaactagcactcatgaaagaaagaatwctacgttacatcaacaacaagaaagagcattggtacccgggggcgatgrttgtcctccgggatgtagatgagaccaacaagctaaaagtatccatatggctctgtcacacgctcaacttccaggacatggggatgaggtacgtgaggagggagctagtgctccaggagatgatcaaagtgctcagggacctcgacattgagtaccggatgctaccactcgatgttaatgtgcggaatgtgcctcctattgaatcaacaaggatgccaaccacatggaattattcctgaaacggtaaacgttcacggggcatttcctatccagttcgagtggtgagagctagaagagcccttgctagcaactggcgagtagaacatgacatgagatattagcgtgcctaacgcagatcacttggtttggtctttaattagtgcgttgtgtagtatgtaagctttggaacacaataattggncaatttcaaatattttccaagcatgtaaaaaaaaaa

SEQ ID NO: 942 - DNA, 753 bp, Triticum aestivum
cctcctcgccgtcgccgccggaatcccctccctcccgtccaaccaccgcagccaccggcaccagcagcaaaagcgaccagctctactcgatgggttcggggagccgcgcggcgtcgtgcctgtgctgcccgttcaagtgcctggcgtgcggcctcttcagctgcctctgcagcatcctcgtctccctcctcgtcacggccggggtcctagccctcatcctctacttcgtcttccgcccgcagatgatcgccgccaccgtcgactccgcctccctcgcccagttcgcgctcggcaccccggccagccccgcgctgctccagtacaacctcaccctcgccatgaccgtgcgcaaccccaacaagcgggtggggctctactacgacggcgtcgaggcgctggccctcttcgacggccagcgcttcgggttcgcgcccctcgaccccttcttccagggccaccaggcgtccaccgaggtcaagccggcgttcggcggccagcaggtgctggagggggatgttacgcaggccaacctcaggtcgcagctggcgggaggcgcggtggaggtggaggtgaagctcaacgccaggctccgcgtcaaggtgtgggcgttcaaggtgcccgggccccgcgccaggatcagctgcccgctctccctccccgccccaggcgccgccgccggcgcccccgcattcaagcccaccgagtgcaaagtctggttctgattcggttctccaccattggggaatctgatct

SEQ ID NO: 943 - DNA, 654 bp, Triticum aestivum
cgagaaacarcacgtataatactatccaaacttcaatcgaatctcaaggtgragatttcccagacaccatgaaagagcaactgaaagcaagcaggattaagatcttggctgccttgctggtcttcgccatggttactcaaggcttggcgattcgggtcaaggggacggtgaggaatgacatcaccgatgaggctgtcagcgcaaaaaccaccctcggtgcaggcagcagcacaaccgtkgacaaccaccatgcaatcccacgggaccagtatagtagccatggaggagaggacggatcaggtggcagtggtggtgatactacaaagaactagtgccattctctgagactgttctgttcgccgaagatatatatattctgatctctaatgtcatattgtatagatgtcagcagcgctaatattattactattcatgtctacatgaaaataagctgctkaagggaagagtaatgtcgaagataatatgcatgttatttacatcctcacagaaggaaaaagctatgtttyrtttkaaaaataragaagaagctmyatatstaatagatgtrayattckcgcgyrtgtgtgtwaggaaackttyatgatkwmcacggyaktcatsaataaatkyatgcmtrcaatctgtcgttttggt

SEQ ID NO: 944 - DNA, 1714 bp, Triticum aestivum
agggagtccctgcctcaccctgatgagcgtgttgaatacgagttctggaccaacagtaacgatgaatgtggtcccaaatgtgacagccagattgatttcgttaagagctttaaaggaccagcacagatacttgagaaaaagggatacacacagttcactcctcattacattacctggtattgcccggaggccttcacactaagcaagcagtgcaagtcccagtgtatcaaccatggaaggtactgtgcacctgacccggaacaggatttcagcaaagggtatgatgggaaagacgtggtggttcaaaatttgcggcaagtctgtgtttataaagttgcgaaggagaataagaagccttggttatggtgggactatgtgaccgattttgcaatccgctgcccaatgaaggaaaagaagtataccaaggaatgtgctgatggagttatcaagtcacttggacttgatcacaaagcaatagataagtgtattggtgatccaaatgctgatgaagaaaatcctgtgctgaaagctgaacaggatgctcagattggcaaaggcgctcgtggcgatgtcactatattaccaacactggtcatcaataatagacaatacagagggaaacttgacaaaggggcagttcttaaagcactttgtgcaggtttccaagaaactactgagcctgccgtttgcttgagtgaagatatacaaaccaacgagtgcttggagaacaatggtggctgttggcacgataaggctgctaacatatctgcatgcaaggatactttccgtggtagagtttgcgaatgcccggttgtgaaaggggtaaaatttgttggtgatggctacactcactgtgaagcttcaggatctggtcgctgtgagattaacaatggtggatgttggaaagagaccaggaatggccggacacactctgcctgcactgatggtggctgtaaatgtccagatgggttcaaaggtgatggtgttcacaaatgtgaagatgttgatgartgcaaggaaaggactgcatgccagtgcaaggaatgtaaatgcaagaacacrtggggaagctacgagtgcgggtgtggtggtggcttgctgtacatgaaggagcatgatacgtgcataagcaaagatgcaggagcacgggtaggctggaatttcctatggtttctattgtttggcctagcggcagtaggaatcgcaggatacgcggtgtacaagtacaggatccggagctacatggattcagagatccgcgctatcatggcacagtacatgcccctggacaaccaaggagagatccccaaccattctcaccatattgagatgtgaagggcagcagcacaggctgataggcagtttgtttcagcttacgggagggatgattgggggaagagaagaacacttgtcttgcatatgttgtgtgtggccatcctgtaaattcagtcgtagatcaaactggaagagaaacacttgtcttgaatggtgtgatcatctctttcttttctgttctctaatcagaaaagagatggcaaactcatgtcatgtgtgcttctttttcctaggttctcctttttaacccatggtgatgattgtcctaacttagagatttgttaaactggatgttgattagtagtacttccaggtgtcttgttggtaaaararaaggaagataagagtacacagtagtagattaatactaaaaaaaaaa

SEQ ID NO: 945 - DNA, 1245 bp, Triticum aestivum
atgctttgtagtgaacggctatcctccgttgwggaatttaccccagtgcttgccaagatatatgcgaaactcaaagaagtgggggagaagtttgaagttgtagctgtatccttggacagtgacgaggaatcattcaataacagtttttcaagcatgccttggctcgccattcctcagggcgacawgatgtgtcagaagcttgtcagttactttgagcttagtgatcttcctacactrgtgctsattggtcctgatgggaagacactgagcagcaatattgcggacataattaatgagcatggtttggatgcatgggaggggttccccttcaatgcagagaagctggaaattctagcggagaaggcaaaggctaaagcagcggcacagacattggagtcccttctggttactggtgatatagactttgtcatcaggaaagatggagcaaaggttcctgtagtagaacttgttgggaagactgtcctcctctacttttcagctaaatggtgtgggccatgcagagccttcctgcctacacttgtggatgtttacaacaagatcaaggagaagaacagcgatttcgagatcgttttcatctctagcgacagggaccagagctcattcgacgacttcttctctggcatgccatggctcgccatccccttggaagacgacaggaaggcgtacctaaaaaagaagttcaagatccgcggaatcccttctctcgtcgccattggccctgatgggaagacggtcaacacggacgcgaagacttcgctggcggtccatggcgcggacgcgtttccgttcaccagtgagaggatccaggagctcgagaagaagatcgacgagatggcgaaggggtggcctgagaagctgaagcatgagctgcacgagcacgagctcttgctgatccgccgccccaggccgtacggctgcgacgggtgcgaagagatgggcacctcctggtcctacaactgcgcggagtgtgacttcgatctgcacaccaagtgcgcgctgggtgaggagaagaagggagaggaggtgaaggggcaggaggatgctgctgccccagctgggtacgtgtgcgagggagacgtctgcaggaaggcctaggtagcgttgtgttgtgtgtgttcctttccagctgaagcgtgtctgaatcatgtgctgtgtggtgtgatgataaataaatcttgcatccgatggtttggcttgggaagtagtatttgtcgtggtgacatt

SEQ ID NO: 946 - DNA, 753 bp, Triticum aestivum
cctcccttcgcctgcgctcgcgcagcagcaacccgccgctccctccggctggccgtcgtccgtcccgctcccggcgcccgcaaattcttcctcccccctcgacatggcgtcctgcccttcggtcaagaacatcctcgtgctggacgcggaggggaagcgcgtggccgtcaagtactatgccgatgactggccctccgcgtcctccaagctggctttcgagaagtcgctcttcgtgaagacccagaagaccagcgccagagcagaggctgatgtggtaatgttcgatggctacatcattgtgtacaagttcatccaagatctccatttttttgtaactggaggagatgaggagaatgagctcattttagcgtcagttcttcagggattttctgatgctgttggcattcttctcagaaacaatgtagacmaaaggaccgcacttgaaaatctggatctcatctttttgtgccttgacgaagttgttgatggagggattgttctggaaacagatggaaatgtgatagccgagaaggtgtcaggccatggattggaaggagctgggtcgttcactgagcagacgataagccaagccctagcgacagcaagagagcacttcgcgaggtctcttctgaagtagtgtgtgtaggcatctttcgggttggcgatgcgcccagcattgaactcgtgtgtttcctcttgtagcacagtgcacctagtttgcaagaaagaaagaaagagcgagaaaatgacttg

SEQ ID NO: 947 - DNA, 759 bp, Triticum aestivum
tcgacccacgcgtccgagcgatctgcactactcacggtaagaaccacaaccaccacaagtgagtgaccatcggagcaaggaaagaccaggagagatggcaatgaggccgcttgtcgtcctggccctggccgtggcgctcgccggcgtggcactgggagggggcgcggcggagggggccggcgagtgcgggaggtcctcccccgaccggatggccctgcgcatggccccgtgcatctcggcggcggacgagccggactcggcgccgtcgagcagctgctgctcggcggtgcacaccatcggcaagagccccagctgcctgtgcgccgtcatgctgtccggcaccgccaagatggccgggatcaagcccgaggtcgccatcaccatccccaagcgctgcaacatggccgaccgccccgtcggctacaagtgcggagattacacgctgccttgatggcccggcaatgctgccgatgaagatgaatgctgtggaaggcgtcgtcgtgtgggaataagcgagtggtgcatgtgccacttatgtggggcactagtgacttcatggaggtgccatcatgtgatgtgtgcttgtgggaatatgtttctataagcatgtaatgtttcgtctgtgttaacgtcaacaaacgtctccgtgtgatttctattttcagacaaaatgctttcacccgactttgtataaaagcctcaaacggamcaaaaatcctacaaacacgcaaacacaccacktyatgttcaaaaaaaaaa

SEQ ID NO: 948 - DNA, 1000 bp, Triticum aestivum
  misc_feature (995)..(995): n is a, c, g, or t
cccccgggtcccgtttccttcgtcggtctgcgctgcgcacccgccggagatctcgcccgccgtcccgctcccccgcgctcccagcgaacccgtccggcttgccccaatggagacctgcccgtcggtgaagaacattctgttgctggactccgaggggaaacgcgtcgccgtcaagtactacacggatgactggcccgtgctctcggcgaagctggccttcgagaagtcggtcttcgtcaagacccagaaagcaagttctggagcagaggctgagattgtaatgtttgatggtcaaattgttgtgtataagttcatccaagacctgcatttttttgttactggaggagacgaggacaatgaacttattttagcatcagttcttcagggatttgctgatgccattgacattattcttagaaataatgtcgacaaaagaacagctcttgaaaatctggatctaatcctattatgccttgatgaaattgttgatggagggattgtcctagaaacagaaggaagtgtgatagctgaaaaggtactagctcatggagcagagggtgccacatcaatcgccgagcagactatagttcaggccctaacaacagcaagagagcactttgccaaatctctgctaatgtgacgtgtccctttctcgtggacgaagatggcattggaccaatgtgttcatttcattgtcaaaggagaaatgaggggaaatgtccgaatctgtgggtgtaaaattacgcgttttcgttgacgttatatgattgttcagttttacgagtgctcgaaagttgtgtggacaaagattgtgaaatgtgaccgtcttgattttgcttggttcacttcatctccttgttgttttactgttaatcgtcgtgtcggtacaatgcttacatacagaggttaacaggccatcttgttctagcttcaaacaagtaaatgttccgctaaagcagcgataccagagtctgccaaaattcacctgcagctanagttt

SEQ ID NO: 949 - DNA, 715 bp, Triticum aestivum
gagcgatctgcactagtcaccgcaagaaccaccaccacaagtgagtgactgtccgagcaaggaaaggcagggagagatggcaatgaggccgctcgtcgtgctcgccctggccgtggcgctggccggcgtggcgctgggagggggcgcggccgagggggccggcgagtgcgggagggcctcccccgaccggatggccctgcgcatggccccgtgcatctcggcggcggacgagccggactcggcgccctccagcagctgctgctcggcggtgcacaccatcggcaagagccccagctgcctgtgcgccgtcatgctgtccggcaccgccaagatggccgggatcaggcccgaggtcgccatcaccatccccaagcgctgcaacatcgccgaccgtcccgtcggctacaagtgcggagattacacgctgccttgatggcccggcaatgctgccgatcaagatgaatgctgtggaaggtgtcgtcgtgtgggaataagcgagtggtgcatgtaccacttatgtggggcactagtgactccatggaggtgccaccatgtgatgtgtgcttgtggaaatatgtttctataagcatgtaatgtttcgtctgtgttaacgtgaacaaacgtctccgtgtggtttctattgtcgtacgaaaggctttcccctgactttatataaaaaggccgcaaacggcagcaacaagtcctacaaacacgc

SEQ ID NO: 950 - DNA, 1037 bp, Triticum aestivum
ggtcctgatgggaagacactgagcagcaatattgcggacataattaatgagcacggtttggatgcatgggaggggttccccttcaatgcagagaagctggaaattctagcggagaaggcaaaggctaaagcagcggcacagacattggagtcccttctggttactggtgatatagactttgtcatcgggaaagatggagcaaaggttcctgtagcagaacttgttgggaagactgtcctcctctacttttcagctaaatggtgtgggccatgcagagccttcctgcctacacttgtggatgtttacaacaaggtcaaggagaagaacagcgatttcgagatcgtcttcatctctagcgacagggaccagagctcattcgacgacttcttctctggcatgccatggctcgccgttcccttggaagacgacaggaaggcgtacctgaaaaagaagttcaagatccgcggaatcccttctctcgtcgccattggtcccgatgggaagacggtcaacacggacgcgaagacttcgctggcggtccatggcgccgacgcgtttccgttcaccagcgagaggatccaggagctggagaagaagatcgacgagatggcgaaggggtggcctgagaaggtgaagcacgagctgcacgagcacgagctcgtgctgatccgccgccccaggccgtacggctgcgacgggtgcgaagagatgggcacctcctggtcctacaactgcgcggagtgcgacttcgatctgcacaccaagtgcgcgctgggtgaggagaagaagggagatgaggtgaatgggcaagatgctgctgctgaggctgctgccccagcggggtacgtgtgcgagggagacgtctgcaggaaggcctaggtagcgtttgtgttgtgtgtgttccttgccagctgaagcgtgtctgaatcatgtgctgtgtggtgtgatgataaataaatcttgcatccgatggtcttgggaggtatttatatatcctggtgacatttatgtgcaaaatcgtaagtataggtttcaga

SEQ ID NO: 951 - DNA, 899 bp, Triticum aestivum
tgaagaagcaatataggaagttgtcactgttggtccatcctgacaagtgcaagcatccacaagcacaagaagcttttggagccctggcaaaagcacagcagctcctacttgatccacaggaaagagggtacattcttgatcaagttacttctgcaaaagaagaactgagggcaaaaaggaaaaaagagttgaggaaagatagtgcatccaagataaaatcccaagtagatgaggggaagtatgaagaacagtttgaaagatcggacgaatttcagaagcagctaataattaaagttcgtgagattttgacagacaaagaatggcgtaggaggaaaatgcagatgaggatatcagaggaagaaggaagactgaagaaggacgaggaggaaacaaaagaaatgtggaagaggaagagagagcatgaagagaagtgggaggagacgagagaccagcgagtctctagctggagggatttcatgaagacaggaaagaaggcacggaaaggagagctcaaacctccaaggctcaagactgaagacccgaacaaatcttatgttcagaggccagtaaagcgtggttaaaaggtgtcgtattcatctgcactcgaagaccattcttgccgcgacctgatccaagccacagcctgtcaagtttatctttcaggctataagcttgggttatggcttgtatgttcccagaccccagtgtagtcagtggaacatagcagataattgcgagcaaaatggacacatatcatctacctagagtgacattggactaatgtacctgtgtagaatgccttgaaaaagaaattttctgttgggaaagaaacgctgaagtggatgttggactatgatccttgtttcaatattcagtgtaagtgtcatgctaatatacat

SEQ ID NO: 952 - DNA, 877 bp, Triticum aestivum
  misc_feature (10)..(10): n is a, c, g, or t
  misc_feature (12)..(12): n is a, c, g, or t
ctcgttgtcntnattgatcttcgtcctggtcgccctccctccgcctgcgctcgcacagcagcaacccgccgctccctccggcacgccgtcgtccatcccgcccccggcgcccgcaaatccgtcctcccccctcgacatggggtcctgcccttcggtcaagaacatcctcgtgctggacgcggaggggaagcgcgtggccgtcaagtactacgccgacgactggccctccgcggcctccaagttggctttcgagaagtcgctcttcgtgaagacccagaagaccagcgccagagcagaggctgatgtggtaatgtttgatggctacattattgtgtacaagttcatccaagatctccatttttttgtaactggaggggatgaggagaatgagctcattttagcgtcagttcttcaggggttttctgatgctgttggcgttcttctcagaaacaatgtagacaaaaggactgcacttgaaaatctggatctcatctttttgtgccttgacgaagttgttgatggagggattgttctggaaacggatggaaatgtgatagccgagaaggtgtcaggccatggattggaaggagctgggtcgttcactgagcagacgataagccaagccctagcgacagcaagagagcacttcgcgaggtctcttctgaagtagtgtgtgtaggcatctttcgggttggcgatgcacccagcattgaactcctgtgtttcctcttgtagcacagtgcacctagtttgcaagaaagaaagaacgagaaaatgacttgaatctttgcgcgcgagttcgttcgtctgttgttgtggtgctcgtcgacattttgtcgcagagatgtatgtgcggcctaagtgcctaactggttac

SEQ ID NO: 953 - DNA, 963 bp, Triticum aestivum
cagcagcagcaaccagctcgactcgccaggatgggttcggggagccgcgcggcgtcgtgcctgtgctgcccgttcaagtgcctggcgtgcggcctcttcagctgcctctgcagcatcctcgtctcgctcctcgtcaccgccggcgtcctcgccctcatcctctacttcctcttccgcccgcagatgatcgccgccaccgtcgactccgcctccctcgcccagttccagctctcccaggccaaccccgcgctgctccagtacaacctcaccctcgccatgaccgtgcgcaaccccaacaagcgggtggggctctactacgacggcgtcgaggccctcgccctcttcgacggccagcgcttcgggttcgcgcccctcgaccccttcttccagggccaccaggcgtccacggaggtgaagccggcgttcggcggccagcaggtgctggagggggacgtcacgcaggccaacctcaggtcgcagctggcgggaggcgcggtggaggtggaggtgaagctcaacgccaagctccgcgtcaaggtgtgggcgttcaaggtgcccgggccccgcgccaggatcagctgcccgctctccctccccgcccccgccgccgcaaacgcccccgcgttcaagcccacggagtgcaaagtctggttctgattcgattctccaccattggggaacctgatctgatccgttctctcgattcgattccttggtgcgtaggttggttgcgcgatgctcttgctgatgtgcgtcgcccgccgtggtttatcttggtagtagagattttcgcatctactgctagtagtactagttggattcgtagctatgcacatactgtcgattggtcgattactcgttcgtttggttctttgttagcgatgttaccatacctagttacattggggttctactattcgaaccgtgttgatatatgcatcgatattcagatttctttcattc

SEQ ID NO: 954 - DNA, 1116 bp, Triticum aestivum
cgggtcgacccacgcgtccgagacctgcccgttcgcgaggcgggcggaggttctttagcgtcggccgagatggcggcggcggcggcgatctgcggggaggacgagccggcgccgcgcgatccggagagcgcggcggcggcgggcggcggggtcgagcggctggatctcggggacggccgggcggcgctcgtggcggggggcaagakgagcktctacctcatggactgcgagccggtgtggggctgcgtcrccacgccggggcgcggcggggagatggaggacgcctgcrccgccgtgccccgcttcgccgacgtgcccgtgcgcctgctcgcccggcgccgcgacctcgaagggctcgggctcgacgccgacgcgctccgcctgccctcccacctcttcgccgtcttcgacggccacggcggctccgaggtgtccaactactgccgggagaggctccacgtcgtgctgagcaaggagctgaggaggccccccagcgatctgggcgagatgagcgatgtggacatgaaggagcactgggacgacctcttcaccaggtgcttccagacggtggatgacgaggtgtcagggcttgcaagcaggctcgtccacggacagccccggtcagacccgatcgccgcggagaacgtgggctccacggcggttgcagtggtggtgtgctcctcccatgtcgtggtcgccaactgcggcgattcacgcatcgtgctctcgcgcgggaaggagcctgtcgccctctcaattgatcagaaggtagatatggttttgtgagcatcatggtattggccacagcatccatgatttggggtttattaatctgattatgccttgttgtttcagcctgacaggaaggatgagcgcgccaggattgaggctgcgggaggcaaggtcatccaatggaatggacaccgagtgtccggcatactggctatgtcacgatccattggtatgcagctataatttatcttgtacaatgtgttgctatttttcatatgacacgcgtcatatttaggaccacccgttgagtttgaaactgtaatcatagcaacatcaaagtatgacgcaaaattgcttggcccggtgtgatagtggtaaatgtct

SEQ ID NO: 955 - DNA, 2282 bp, Triticum aestivum
cggacgcgtgggctggaatcggtctgcagagaatctctatggttatcctgcatcagaagtacttggtcaggatgcactcatgctgctggttgattcccgtgacctcagtgtggtaaatgatatgtttcgacgtatttctttgggtgagagttggactgggaagtttccagttaagaacaaggcaggggataggtttttagctgttggcaccaacactccattttatgatgaggatggcagtttggtgggcattatttgtgtttcaagtgattcacgcgcattggaggagatactcagtggaccttcaacctctgcaaggtcccattcagaatcatctagcccctcctgttgtgatggcagttgcagcaacagtaatcgaaaagccagtttgttgaacagaaatccgtttgatccccagcagtctactatagcctccaagataacaaatttggctaacaaggtcacaaataaagttcgttcgagggtcaagatggatgagaatggcatggtacgggaaggtggcagtggtgagagtcagtgytctgatcgtgataacaaggaaggtccatctagtggaccaagtacaccaagaggagatgcaccacatggcgccttcggcaccgaagagaattcccctggaaaatcaaccaaaacaaatggtgatgaatcagaagcgaaaataggtctccacaagatcttgagctcaaaagcagaggcattgttgaacaagaaagggataacatggccttggaaagggcgggagaatgacgggcctgattgcagaaatcaagtgacctggccatcattgcatggtgagcaagagaatggccagaatcatccgaaaatctctgacactcaagtggccgaattcaaccaacctaataaaaatgaggcatcaggttcctggtcttctttcaacaataacagctcaagtagtgcaagcagcactggaagcaccaatagtagtgctctatacaaaatagaccatgaagcagactgtctggattatgaaatcctgtgggaagatcttgtaattggagaacaagtaggccaaggctcctgtgggacagtatatcatgccttgtggtatggctcggatgtgggtgtgaaagttttctccaggcaggaatattccgaggaagtgatacaggcctttcgacaagaggtatcccttatgaagaaattacgtcatcctaatatactgctcttcatgggtgcggttacatctccacaccgcctytgtattgttaccgagttcctcccacgtggaagtttatttcgcttacttcaaagaagcactaccaagttggattggagacgacgtgttcacatggctttagatgttgcaaggggcatgaattatcttcatcactatagcccacctatcattcatcgagatttaaagtcgtcaaatctgctggtggataagaactggactgttaaggttgcagattttggtctttcacgtctcaagcgtgaaacttatctgacaacaaaaacaggaaaaggaacgccacaatggatggctccggaggtattgcgcaatgaaccttcagatgagaagtctgatgtgtatagctatggggtgatcctatgggaacttgtcactcagaagataccgtgggaaaatctcaattcaatgcaggtcattggtgcagtaggtttcatgaaccaaaggttggagattcccagtgaaacagatccttactggacatcacttatactcagttgttgggaaaccgacccacaaagccgtccgtcgttccaagaacttctggagaagctcagggaactgcaaaggaagtacgcggtccagaatcaggtgcagcgaaatgcatctgccgctgcgaagaacagcatcatcgaggaatgaaagattccaacttcttgctaaggcggtgggtgtgcgaatgaggagggaacattgtcggtcggtgatggagcgacgttttaacccaagaaaagattcgtacctcaggtgtgattgtttcacgagaagccaatgctgaagattgtgcagatgaggtgtcctctgaattcgtgggaggatatgcctgaacttcctccgaccgcaacttctggcagcaaagattagagtagcgagtgagccgaggctggcgcttttggggttctacattccgtggcgatgcgtgactaacatgcgatcggattgatctggcttgcatttgtaacacggagaggacggtgttgctgtgtagattgttctgatgacaaattgtacacgagtggccaatcaacaagaactttgtaagatttgtact

SEQ ID NO: 956 - DNA, 1919 bp, Triticum aestivum
gggtcggctccacgtctcccatcaggaaacgaatttaagccggaggggacaagtttccaatccgtccatcctctaatcccgtagcagccagcgtagccgcccccacctgctctcctccgctccgggatccatccacctagggttctgcggctgaccggagtcaaggccatggcgcggaagatgctcaaggacggggaggcgcccctcgtcgccgacgacggcgggacctacgactacgacctcttcgtcatcggcgccggcagcggcggcgtccgcggctcccgcaccgccgccggattcggggccaaggttgcgatctgcgagctcccgttccaccccatcagctccgagtggctgggaggacacggcggaacgtgcgtgatacgtggctgcgtcccgaagaagatactcgtctacggggcgtctttccggggggaattcgatgacgccaagcaattcgggtgggagatcaacggggacatcaactacaactggaaaaagttgctggaaaataagactcaagaaattgtgagattaaatggagtgtacaagagaatccttggtggttctggtgtgacgatgatcgaaggggcaggaagtatagtggatgctcatactgtcgaagtcacccagccagatggatcaaagcaaaggcacacgaccaagcacatattgattgcaactggtagccgggcaactctggtcgacattcctggaaaggagctggctattacttcagatgaggctttaagtttggaggagctaccgaaacgcgccgttattcttggtggcggatatattgctgttgaatttgcttctatctggaaagggttgggtgctgaagtagatctattttataggaaagagcttcctctaaggggttttgatgatgagatgagaacggttgtggcaagtaaccttgaaggaaggggaatccgattgcatccagggacaaatttgactgagttgagtaaaacagccgatggcattaaagttgtgacagataagggagatgagctcattgcagatgttgttctttttgccacaggtcgtgcgccgaactccaataggctgaacctggaagctgttggtgttgaggttgatcaaataggagccatcaaggttgatgaatactcccgtacatcagttccaagtatatgggctgtgggtgatgtaacaaatcggattaacctaacacctgttgctctgatggaggctacttgcttcgctaaaactgtgtttggtggccagacagttaagcctgattataaagatgtaccttgtgctgttttctgcattccaccgctatctgtcgtcggtctcagcgaacaagaggctttggcggaagccaagaatgatcttcttgtttacacatcaagtttcaacccaatgaagaacagcatatccaaacgcgtggagaagtctaccatgaaactggtggttgatgctgataccgataaggtactcggtgcagccatgtgtggaccagatgcagctgaaattatgcagggcattgctgttgcgctcaaggctggagctaccaaagcgaccttcgacagcaccgtcgggatccacccttctgcagcagaagagttcgtgacgatgcggaccttgaccaggcgcgtgagcccgccatccaagccaaagacgaacttgtaaggaagatccctgcaatgttttggactaaaattataccggtgtggcgaaggaaactgtgtacacgtagatgcttgtttcagttcgttagctctgcgcttggcatttgacctgaaagggtgatacggtgtatttgatggtagaaataagtttctgtggaacagtttgtacagaaatcgtgggtattgtcatgatttccaacccaaataagcccttgaagttgaaatrttttcccatttatggcctgcatgtcatgccagtcc

SEQ ID NO: 957 - DNA, 871 bp, Triticum aestivum
gccgtgcgttgcgttgtccccccgggtcccgtttccgtcgtcggtccgcgctgcgcaaccgccggagatctcgtccgccgtcccgctcccccgcgctcccagcgaacccgtccggcttcccccaatggagacctgcccgtcggtgaagaacattctgttgctggactccgaggggaagcgcgtcgccgtcaagtactacacggatgattggcccgtgctctcggcgaagctggccttcgagaagtcggtcttcgtcaagacccagaaagcaagttctggagcagaggctgagattgtaatgtttgatggtcaaattgttgtatataagtttatccaagacctgcatttttttgttactggaggagacgaggacaatgaacttattttagcatcagttcttcagggattcgctgatgctattgacattattctcagaaataatgtcgacaaaagaacagctcttgaaaatctggatctaatcctattatgccttgatgaaattgttgatggaggggttgtcctagaaacagaaggaagtgtgatagctgaaaaggtactagctcatggagcagagggtgccacatcaatcgccgagcagactatagttcaggccctaacaacggcaagagagcactttgccaaatctctgcttatgtgacgtgtcctgttcttgtggacgaagatggcattggagattggaccaatgtgttcatttcattgtcaaaatagaaatgtccgaatctgtgggtgtaaaattacgcgttttcgttgacgttatatgattgttcagttttacgagtgctcgaaatttgygtggacaaagattgtgaaatgtgaccgtctcgattttggttggttcacttcatctcct

SEQ ID NO: 958 - DNA, 830 bp, Triticum aestivum
cgtttccttcgtcggtctgcgctgcaaccgccggagatctcgtccgccgtcccgtccccccgcgctcccagcgaacccgtccggcttcccccaatggagacctgcccgtcggtgaagaacattctgttgctggactccgaggggaagcgcgtcgccgtcaagtactacacggatgattggcccgtgctgtcggcgaagctggccttcgagaagtcggtgttcgtcaagacccagaaagcaagctctggggcagaggctgagattgtaatgtttgatggtcaaattgttgtgtataagttcatccaagacctgcatttttttgttactggaggagacgaggacaatgaacttattttagcatcagttcttcagggattcgctgatgccattgacattattcttagaaataatgtcgacaaaagaacagctcttgaaaatctggatctaattctattatgccttgatgaaattgttgatggagggattgtcctagaaacagaaggaagtgtgatagctgaaaaggtactagctcatggagcagagggtaccacatcaatcgccgagcagactatagttcaggccctaacaacagcaagagagcactttgccaaatctctgctaatgtgacgtgtcctgttcttgtggacgaagatggcactggaccaatgtgttcatttcagtgtcaaaggagaaatgaggggaaatgtcggaatctgtgggtgtaaaattacgcgttttcgttgacattatatgtgttcagttttacgagtgctcgaaatttgtgtggacaaagattgtgaaatgtgaccgtctcgattttgcttggttca

SEQ ID NO: 959 - DNA, 1226 bp, Triticum aestivum
aagtgggggagaagtttgaagttgtagctgtatccttggacagtgatgaggaatcattcaataacagtttttcaagcatgccttggctcgccattccccatggcgacaagatgtgtcagaagcttgtcagttactttgagcttagtgatcttcctacactagtgctgattggtcctgatgggaagacactgagcagcaatattgcagacataatcaatgagcatggtttggatgcatgggaggggttccccttcaatgcagagaagctggaaattctagctgagaaggcaaaggctaaagcagcctcacagacattggagtcccttctggttactggtgacgtggactttgtcatcgggaaagatggagcaaaggttcctgtagcagaacttgttgggaagactgtcctcctctacttttcagctaaatggtgtgggccatgcagagccttcctgcctacacttgtggatgtctacaacaagatcaaggagaagaacagcgatttcgagatcgtcttcgtctctagcgacagggaccagagctcattcgacgacttcttctctggcatgccatggctcgccatccccttggaagacgaaaggaaggcgtacctgaaaaagaagttcaagatccgtggaatcccttctctggtcgccattggccccgatgggaagacggtcaacacggacgcgaagacttcgctggcggtccatggcgccgacgcgtttccgttcaccgacgagaggatccaggagctggagaagaagatcgaggagatggcaaaggggtggcctgagaagctgaagcacgagctgcacgagcacgagctcgtgctgatccgccgccccaggccgtacggctgcgacgggtgcgaagagatgggcacctcctggtcctacaactgcgcggagtgcgacttcgatctgcacaccaagtgtgcgctgggtgaggagaagaagggagaggaggtgaatgggcaggagcatgctgctgccccagctgggtacgtgtgcgagggagacgtctgcaggaaggcctaggtagcgttgtgttgtgtgtgttccttgccagctgaggcgtgtctgaatcatgtgctgtgtggtgtgatgataaataaatcttgcatccgatggtttggcttgggaagtatttgtcgtggtgacatttatgtgcaaaatcggtctaagtttatggtttcagatctttgcctttttggcatttgctct

SEQ ID NO: 960 - DNA, 1332 bp, Triticum aestivum
gtggcagttaaagtattctccaggcaggaatattcagaagaaatgatacgtaccttcagacaagaggtgtcactgatgaagaagctacgtcatcccaatattatacttttcatgggtgcagttgcttctcaggaacggctttgtattgttacggaatttctcccacgagggagcttgtttcgcttactacgaaaaaccactggcaagttggatccaagacggcgagttcacatggctatagacatcgcaaggggcatgaattatcttcacagttccagccccaccgttgtacatcgtgatctaaaatcgtcaaatctgttggttgataagaactggactgttaaggttgcggactttggtctttcacgcctcaaaatcgaaacattcctgactacaaaaactgggaaaggaacaccacagtggatggctccagaagtgctacgtaatgaaccttcaaatgaaaagtctgacgtgtacagctacggagtggtcctatgggagcttgttactcagaagattccttgggatactctcaatacaatgcaggttatcggagctgtgggtttcatggaccacagattggaaattccgagtgacatagatcctcagtgggcatcaatgattgagagttgttgggacagtgacccacagcgccgcccttcattccaagaactcctggagaggctccgtgagctgcaaaagaaatacgccctgcaggtgcagatgcagcggagcgcggctgggaaaggcgctgaaaagatgagcgttgatgatggctagctaaggctcaggccccgacttggatggattgtgtatttgccatttatgaaaatgggccattgggctggatccggaaggttcgaggaagtcctccatgcttaccccgggaggaactgtggtgggaatcgagacaaggtgcctgaaaggtggttttaagcttgatgaatcgcgaggctgaagccctgagacgcagtttctttccggagaggaaggccatagaacgaacactcgtcacataacagtcgttcgaggcactgtaggagggacgccttgatcagttcttgatggattttttgtataccaagacttgtatacatacatcctttctggtgtgactagttagggaagctcaatggcttgggagtttgaacgatcttattcgtttgcagcatgcaccacgatcaaaatcgaaagggtggttactgtacgcactttccctatttcaaattataaggtgtttttttttgtagagtaatgtgtgatccatatgaccatggaattggcatcaccagtttcatttttataatattagtgattccatcttttacctcc

SEQ ID NO: 961 - protein, 230 aa, Malus x domestica
MNRLRHPNVLLFMGAVTSPQRLCIVTEFLPRGSLFRLLQRNTSKLDWRRRVLMAIDIARGMNYLHHFNPPIIHRDLKSSNLLVDRNWTVKVGDFGLSRLKHETFLTTKTGKGTPQWMAPEVLRNEPSDEKSDIYSYGVILWELATEKIPWDNLNSMQVIGAVGFMDQRLEIPKDVDPQWTSLIESCWQSDAAARPTFQELLERLRDLQRQYNLQFQAARTAMGDNAPKEL

SEQ ID NO: 962 - protein, 496 aa, Malus x domestica
MSRKMLIDGEVNQPNEQEAHYDFDLFVIGAGSGGVRASRFSANFGAKVGICELPFHPVSSEVIGGVGGTCVIRGCVPKKILVYGASFGGEIEDARNYGWEVNEKVDFNWKKLLQKKTDEIVRLNGIYKRLLSNSGVKFFEGEGKIVGPNDVEVTQLDGTKLSYSAKHILIATGSRAQRPAIPGQELGISSDEALSLEELPKRAVVLGGGYIAVEFASIWRGMGASVDLFFRKELPLRGFDDELRAVVARNLEGRGIDLHPQTNLTELVKTEDGIKVRTDHGEELIADVVLFATGRSPNTKRLNLAAVGVEVDKTGAIKVDEYSRTNVPSIWAVGDVTNRVNLTPVALMEGTCFAKTVFGGEPSKPDYRDIPCAVFCIPPLSVVGLTEEQAIEQAKGDILVFTSTFNPMKNTVSGRQEKTIMKLIVDAETDKVIGASMCGPDAAEIMQGIAIALKCGATKAQFDSTVGIHPSSAEEFVTMRSATRRIAAGTKPKTNL

SEQ ID NO: 963 - protein, 358 aa, Malus x domestica
WPGDPDDKGIQTYNDAKHFAISAKVPEFSNKNRTLVVQYSIKFEQDIECGGGYIKLLSSYVNQKKFGGDTPYSFMFGPDLCGTQTKKLHVILSYQGQNYPIKKDLQCETDKLTHFYTFILRPDATYSVLVDNRERDSGSMYTDWDILPPKKIKDVNAKKPADWDDREYINDPNEVKPEGYDSIPSEIPDPKAKEPEDWDEEENGIWRRSKIPNPAYKGPWKRKKIKNPNYKGKWKTPWIDNPEFEDDPDLYVLKPIKYVGIEVWQVKAGSVFDNILICDDPQYAKEVVEEVFSNRDAEKEAFEEAEKQRKAREEEEAKRAREEGEKRKRERDREYGRDRRRRRRHDPHDYLDDYHDEL

SEQ ID NO: 964 - protein, 322 aa, Malus x domestica
GRFVVEKNSLKVTSPSSMKGLYECAIGNFGVPQYGGTLVGTVYYPKTNQKACKGFEDFDESFKPKPGGLPTFLLVDRGDCYFTLKAWNAQKGGAAAILVADDRNEPLITMDNPEEENADADYLQKITIPSALISKELGESIKKSLSGGEMVNINLDWTEALPHPDERVEYEFWTNSNDECGPKCDSQIEFVKSFKGAAQVLERKGYTQFTPHYITWYCPEAFVLSKQCKSQCINHGRYCAPDPEQDFSKGYDGKDVVVQNLRQACLYKVANESGKPWLWWDYVTDFAIRCPMKDKKYTEECANQVIESLGADLKNTEMYWRP

SEQ ID NO: 965 - protein, 275 aa, Malus x domestica
  misc_feature (130)..(130): Xaa can be any naturally occurring amino acid
  misc_feature (204)..(204): Xaa can be any naturally occurring amino acid
MSFRDLEAGRGTNYSRRGDLINGKRDPTQAVASGIFQINTAVSTFQRLVNTIGTPKDTPDLREKLHKTRLHIGQLVKDTSEKLKQVSERDHHTEVNASKKITDAKLAKDFQAVLKEFQKAQRLAAERETXYAPFVPQAVLPTSYTASEIDVNSDKSLEQRALLVESRRQEVVLLDNEIAFNEAIIEEREQGIQEIQQQIGEVNXIFKDLAILVHEQGTMIDDIGSNIEGAHAATGQAKSQLVKASKTQRSNSSLTCLLLVIFGIVLLIVIVVLAA

SEQ ID NO: 966 - protein, 285 aa, Malus x domestica
  misc_feature (130)..(130): Xaa can be any naturally occurring amino acid
  misc_feature (204)..(204): Xaa can be any naturally occurring amino acid
MSFRDLEAGRGSNYSRRGDLGTGKQDPTQAVASGIFQINTAVSTFQRLVNTIGTPKDTPDLREKLHKTRLHIGQLVKDTSEKLKQVSERDHHTEVNASKKITDAKLAKDFQAVLKEFQKAQRLAAERETXYAPFVPQAVLPTSYTASEIDVNSDKSLEQRALLVESRRQEVVLLDNEIAFNEAIIEEREQGIQEIQQQIGEVNXIFKDLAILVHEQGTMIDDIGSNIEGAHAATGQAKSQLVKASKTQRSNSSLVIYSHLFYDILHIFVYIFFQMFSSFSCIYTF

SEQ ID NO: 967 - protein, 572 aa, Malus x domestica
MDEDFDMPAAEEMNEDFDLPGEGPALKVGEEKGIGTQGLKKKLLKEGEGWDNPKNGDEVEVHYTGTLLDGTKFDSSRDRGTPFKFTLGQGQVIKGWDEGIRTMKKGEDALFTIPPELAYGESGSPPKIPPSATLQFDVELLSWTSINDISKDGGIIKKILKEGEKWENPKDLDEVIVNFEAQLEDKTLVAKYQAVEFTVKDGYFCPAISKAVKTMKKGEKVLLTVKPQYGFGDKGKPASGSEGAVPPNTTLHITLELVSWRTVSEVTDDKKVIKKILKEGEGYERPNEGAVVKLKLTGKLQDGKEFLKKGHVEGEDLFEFKTDEEQVIDGLDRAVQTMKKGEVALLTIAPEYAFGSVEFQQELAVVPPNSTVNYEVELVSFEKDKESWDMNTEEKIEAAGKKKEEGNALFKAGKYARASKRYEKAVKYIDYDTSFGEEEKKQAKVLKVACNLNDAACKLKLKDYKQAEKLCTKVLELEGRNVKALYRRAQAYIQLADLDLAELDIKKALEIDPNNRDVKLEYKTLKEKMKEYNKKEAKFYGNMFAKLTKSDSPDSNKEAAKDAEPMSVDSKA

SEQ ID NO: 968 - protein, 275 aa, Malus x domestica
  misc_feature (130)..(130): Xaa can be any naturally occurring amino acid
  misc_feature (204)..(204): Xaa can be any naturally occurring amino acid
MSFRDLEAGRGSNYSRRGDLGTGKQDPTQAVASGIFQINTAVSTFQRLVNTIGTPKDTPDLREKLHKTRLHIGQLVKDTSEKLKQVSERDHHTEVNASKKITDAKLAKDFQAVLKEFQKAQRLAAERETXYAPFVPQAVLPTSYTASEIDVNSDKSLEQRALLVESRRQEVVLLDNEIAFNEAIIEEREQGIQEIQQQIGEVNXIFKDLAILVHEQGTMIDDIGSNIEGAHAATGQAKSQLVKASKTQRSNSSLTCLLLVIFGIVLLIVIVVLAA

SEQ ID NO: 969 - protein, 418 aa, Malus x domestica
MKEKLGFLVCVWFLLCRVCVGRFVVEKNRLKVTSPSSMKGDYECAIGNFGVPPYGGTLVGTVYYPKTNQMACKGFEDTDETFKPKPRGLPTFVLVDRGDCYFTTKAWNAQKAGAAAILVADDRNEPLITMDTPEEENADAADYLQNITIPSALISKELGDSIKKSLSGDEMVNINLDWTEALPHPDERVEYEFWTNSNDVCGPKCDSQIEFVKNFKGAAQVLERKGYTQFTPHYITWYCPEAFVSSKQCESQCINHGRYCAPDPEQDFSEGYDGKDVVVQNLRQACFYKVANESGKPWLWWDYVTDFAIRCPMKEKKYNQECANQVIESLGADLKKIQECIGDPEADEENAVLKAEQDAQIGKGSRGDVTILPTLVINRVQYRGKLDKGAVLKAICSGFLENTEPAVCLSEDVQTNEC

SEQ ID NO: 970 - protein, 217 aa, Prunus armeniaca
GTSYTGILGMPGMTAYAGFYEVCSPKKGETVYVSAASGAVGQLVGQFAKLSGCYVVGSAGTKEKVDLLKKKFGFDGAFNYKEEPDLDAALKRFFPEGIDIYFENVGGKMLDAVLPNMRVHGRIAVCGMISQYNLEQPEGVHNLMHLVIKQVRMEGFLVFNYYHLYGKFLEMVLPAIKEGKITYVEDVVEGLESAPAALIGLFAGRNVGKQVVLVSRE

SEQ ID NO: 971 - protein, 274 aa, Prunus armeniaca
MSFRDLEAGRGSGFSRRDIVNGKQDPTQAVASGIFQINTAVSTFQRLVNTIGTPKDTPELREKLHKTRLHIGQLVKDTSEKLKQVSERDHHTEVNASKKITDAKLAKDFQAVLREFQKAQRLAAERETAYAPFVPQAVLPSSYTASEIDISSDKSPEQRALLVESRRQEVVLLDNEISFNEAIIEEREQGIQEIQQQIGEVNEIFKDLAILVHEQGTMIDDIGSNIEGAHAATGQAKSQLVKASKTQRSNSSLTCLLLVIFGIVLLIVIVVLAA

SEQ ID NO: 972 - protein, 571 aa, Aquilegia formosa
QYGGTMVGTVVYPKANQKACKAFDDDASVKSKPGALPTFILADRGDCYFTLKAWNAQNAGAAAILVADDKIEPLITMDTPEEDNSHADYLQNITIPAALISKAFGDSIKKALANGDMVNINLDWRESLPHPDERVEYEFWTNSNDECGPKCESQIDFVKNFKGAAQILEQKGYTQFTPHYITWYCPEAFILSKQCKSQCINHGRYCAPDPEQDFSRGYDGKDVVVQNLRQACLYKVANESGKSWLWWDYVTDFAIRCPMKEKKYTKECADEVIKSLGLDLKKIDQCIGDPEADVENPVLKAEQDAQIGKGSRGDVTILPTLVINNRQYRGKLDKGAVLKAICAGFQETTEPAVCLSDGIETNECLENHGGCWHDEVANISACKDTFRGRVCECPVVQGVKFVGDGYTHCEASGALRCEINNGGCWKKTQDGRTYSACVDNNSKGCKCPPGFKGDGVNKCEDVDECKERLACQCSECRCKNTWGSYECSCSGNSLYMHEHDTCIGQESNTRFSGSFVLVIFLGLAAAGVAGYAVYKYRIRRYMDSEIRAIMAQYMPLDNQAEVPNHVSHGDI

SEQ ID NO: 973 - protein, 271 aa, Aquilegia formosa
MSFQDLESGRPIASRREYINGKQDPTQAVASGVFQINTAVSSFQRLVNTLGTPKDTPELRDKLHKTRLHIGNLVKDTSAKLKQASEADLYTEVSASKKIADAKLAKDFQAVLKEFQKAQRLAAERETAYSPVEKKVPSSYTASELDINSDRNPEQRSALVESRRQEVLLLDNEIVFNEAIIEEREQGIQEIQQQIGEVNDIFKDLAVLVHEQGVMIDDIDSNIESSHAATAQAKSQLVKASKTQKSNSSLTCLLLVIFGVVLIIVMIVLMA

SEQ ID NO: 974 - protein, 345 aa, Aquilegia formosa
PEAMNEDMDFGDETPMFKVGEEKEIGKQGLKKKLIKEGERFDTPDNGDEVEVHYTGTLLDGTKFDSSRDRGTPFKFKLGQGQVIKGWDQGIKTMKKGENALFTIPPELAYGESGSPPTIPPNATLQFDVELLSWSSVKDICKDGGIFKKIVTEGEKWENPKDLDEVFVKYEARLEDGTLVSKSEGAEFTVKDDHFCPALSKAVKTMKKGEKVILTVKPQYGFGEMGRPASGAEGAVPPNATLLITLELVSWKTVTEVTDDKKVIKKILKEGEGYERPNDGTVAKVKLIGKLQDGTVFFKKGHDDELFEFKTDEEQVITGLDRAVMTMKKGEVALLTIDPEYAFGS

SEQ ID NO: 975 - protein, 243 aa, Aquilegia formosa
MGETDDELLKNFFAEVSEVERENEVQRILSCFKLNAFEYLNLPFDSSPEDVKRQYRKLSLLVHPDKCKHPQAKEAFGALAKAQQLLLEPQEREYLLSQVNAAKEELRSKRKKLLKKDNASKLKSQVDEGKYEQQYEKSDEYQQQLKMKVRELLTEHEWRRRKMQMRISEEEGRLKKDEEETKEMWKKKREHEEQWEGTREKRVSSWRDFMKTGKKAKKGEIRPPKLKTEDPNKSYVQRPVKRG

SEQ ID NO: 976 - protein, 495 aa, Aquilegia formosa
MARKMLIDAEVSNSVEEEQYDFDLFVIGAGSGGVRASRTSAALGAKVAICELPFHPISSEVIGGVGGTCVIRGCVPKKILVYGASFAGEFEDARNFGWELNEKIDFNWKKLLHNKTQEILRLNGIYKRMLSNSGVKMFEGEGKVVGPHEVELTQLDGTKLSFSTKHILIATGSRAQRVPIPGQELAITSDEALSLEELPKRAVVLGGGYIAVEFASIWRGMGATVDLFYRKELPLRGFDDEMRNTVARNLEGRGIKLHPGATLKELIKTDEGIRVITDNGQELMADVVLFATGRTPNTKRVNLQAAGVELDRSGAVKVDEFSQTNIPSIWAVGDVTNRINLTPVALMEGSCFSKTVFGGQPTKPDYRDVPCAVFCIPPLSVVGLSEEQAVEGAKGDIVIFTSTFNPMKNTISGRQEKTMMKLIVDGETDKVLGASMCGPDAAEIMQGIAIAMKCGATKAQFDSTVGIHPSAAEEFVTMRTETRRIAAGSKPKTNL

SEQ ID NO: 977 - protein, 738 aa, Arabidopsis thaliana
MENPNPPAEKLLKKIRELEESQEDLKREMSKLKVSAEIKRRSHSSSPKRPSRRNSGEGTPLWRKTGAASFRHASPLRKESHSKDGVAGGGDGPSAGKFTDKQYLNILQSMAQAVHVFDLNGQIIFWNSMAEKLYGFSAAEALGKDSINILVDGQDAAVAKNIFQRCSSGESWTGEFPVKNKMGERFSVVTTISPFYDDDGLLIGIICITNDSALFQRPRVPPAKNRWQEGDSSFCRGTNGVASRLGFDSKEAVVSKLGLDSQQPIQAAIASKISDLASKVGNKVRSKMRAGDNNASHPEGGNGGSHQSDQGFFDAAFSDQREDAETNDASTPRGNLIQSPFGVFLCNDDKSSSKASGESNDENDRNSVVPKKLTSKTEEWMVKKGLSWPWKGNEREGLERRNAHSVWPWVHNEQQKEEAHHSNSYNSVKSESLASESNKPANNENMGSVNVNSASSASSCGSTSSSVMNKVDMDSDCLDYEILWEDLTIGEQIGQGSCGTVYHGLWFGSDVAVKVFSKQEYSEEIITSFKQEVSLMKRLRHPNVLLFMGAVASPQRLCIVTEFLPRGSLFRLLQRNKSKLDLRRRIHMASDIARGMNYLHHCSPPIIHRDLKSSNLLVDRNWTVKVADFGLSRIKHETYLTTNGRGTPQWMAPEVLRNEAADEKSDVYSFGVVLWELVTEKIPWENLNAMQVIGAVGFMNQRLEVPKDVDPQWIALMESCWHRYINHIKHYIYLARGK

SEQ ID NO: 978 - protein, 447 aa, Arabidopsis thaliana
MDIFDNSDLEYLVDEFHADFDDDEPFGEVDVTSESDSDFMDSDFDFELSESKTNNETSALEARNGKDIQGIPWESLNYTRDRYRENRLLHYKNFESLFRSREELDKECLQVEKGKNFYDFQFNTRLVKSTIAHFQLRNLVWATSKHDVYFMNNYSLMHWSSLLQRGKEVLNVAKPIVPSMKQHGSLSQSVSRVQISTMAVKDDLKLREGSKESLSKINEPEVAFCTKLTSADNDITNSVDIYNAPSGSLRVMTANNDCTVRLFDATNFALLNRFAFHWSVNNISTSPDGKLVAVLGDSPECLLADTGSGKVIHGLEGHLDYSFSSAWHPNGQILATGNQDTTCRLWDVRNLSQSLKVLKGNMGAIRALRFTSDGRFLAMAEPADFVHLFDTEAGYSQCQEIDLFGEIAGISFSPDTEALFVGVADRTYGSLLEFNRKRNHSYVDSIF

SEQ ID NO: 979 - protein, 155 aa, Arabidopsis thaliana
MGIQETDPLTQLSLPPGFRFYPTDEELMVQYLCRKAAGYDFSLQLIAEIDLYKFDPWVLPNKALFGEKEWYFFSPRDRKYPNGSRPNRVAGSGYWKATGTDKIISTEGQRVGIKKALVFYIGKAPKGTKTNWIMHEYRLIEPSRRNGSTKVTNKI

SEQ ID NO: 980 - protein, 773 aa, Arabidopsis thaliana
MENPPAEELLKKILELEESQEHLKQEMSRLKVSTELRQRSHSVSPHRPARRNIGEGAPSWRKSGAASFRNASPLRKESRIQNSMRLRSEVGGGGPSAGKFTDKQYLNILQSMAQAVHAFDLNMRIIFWNAMAEKVYGYSAAEALGENPINVIADDRDAAFAMNIARRCVRGESWTGEFPVKSKSGDRFSAVTTCSPFYDDDGALMGIICITSNTAPYLNPRISLAKLKAQEEGETSSIPARNSFASKLGLDSRGAVISKLGLDSDQPIQVAIASKISDLASKVSNKVRSKMRAGDNSATLSEGGSGDSHQKDHNVFGATLVDHRDDAASSGASTPRGDFIQSPFGVFTCNDEKFVSKPFKDSSDESDGKPAIHKVLTSKAEEWMVKKGLSWPWKGNEQEGSKGRPTNSVWPWVQNEQKKERCHQINPSAGVQYESHAFESNKPINNEASSLWSSPINANSTSSASSCGSTSSSVMNKVDTDSEGLEYEILWDDLTIGEQVGQGSCGTVYHGLWFGSDVAVKVFSKQEYSAEVIESFKQEVLLMKRLRHPNVLLFMGAVTSPQRLCIVSEFLPRGSLFRLLQKSTSKLDWRRRIHMALDIARGMNYLHHCSPPIIHRDLKSSNLLVDKNWTVKVADFGLSRIKHETYLTSKSGKGTPQWMAPEVLRNESADEKSDIYSFGVVLWELATEKIPWETLNSMQVIGAVGFMDQRLEIPKDIDPRWISLMESCWHSDTKLRPTFQELMDKLRDLQRKYMIQFQATRAALSDNSLLKDN

SEQ ID NO: 981 - protein, 765 aa, Arabidopsis thaliana
MENPNPPAEKLLKKIRELEESQEDLKREMSKLKVSAEIKRRSHSSSPKRPSRRNSGEGTPLWRKTGAASFRHASPLRKESHSKDGVAGGGDGPSAGKFTDKQYLNILQSMAQAVHVFDLNGQIIFWNSMAEKLYGFSAAEALGKDSINILVDGQDAAVAKNIFQRCSSGESWTGEFPVKNKMGERFSVVTTISPFYDDDGLLIGIICITNDSALFQRPRVPPAKNRWQEGDSSFCRGTNGVASRLGFDSKEAVVSKLGLDSQQPIQAAIASKISDLASKVGNKVRSKMRAGDNNASHPEGGNGGSHQSDQGFFDAAFSDQREDAETNDASTPRGNLIQSPFGVFLCNDDKSSSKASGESNDENDRNSVVPKKLTSKTEEWMVKKGLSWPWKGNEREGLERRNAHSVWPWVHNEQQKEEAHHSNSYNSVKSESLASESNKPANNENMGSVNVNSASSASSCGSTSSSVMNKVDMDSDCLDYEILWEDLTIGEQIGQGSCGTVYHGLWFGSDVAVKVFSKQEYSEEIITSFKQEVSLMKRLRHPNVLLFMGAVASPQRLCIVTEFLPRGSLFRLLQRNKSKLDLRRRIHMASDIARGMNYLHHCSPPIIHRDLKSSNLLVDRNWTVKVADFGLSRIKHETYLTTNGRGTPQWMAPEVLRNEAADEKSDVYSFGVVLWELVTEKIPWENLNAMQVIGAVGFMNQRLEVPKDVDPQWIALMESCWHSEPQCRPSFQELMDKLRELQRKYTIQFQAARAASIDNSSLKEK

SEQ ID NO: 982 - protein, 492 aa, Arabidopsis thaliana
MAVSSSHHAVLFPYMSKGHTIPLLQFARLLLRHRRIVSVDDEEPTISVTVFTTPKNQPFVSNFLSDVASSIKVISLPFPENIAGIPPGVESTDMLPSISLYVPFTRATKSLQPFFEAELKNLEKVSFMVSDGFLWWTSESAAKFEIPRLAFYGMNSYASAMCSAISVHELFTKPESVKSDTEPVTVPDFPWICVKKCEFDPVLTEPDQSDPAFELLIDHLMSTKKSRGVIVNSFYELESTFVDYRLRDNDEPKPWCVGPLCLVNPPKPESDKPDWIHWLDRKLEERCPVMYVAFGTQAEISNEQLKEIALGLEDSKVNFLWVTRKDLEEVTGGLGFEKRVKEHGMIVRDWVDQWEILSHKSVKGFLSHCGWNSAQESICAGVPLLAWPMMAEQPLNAKLVVEELKIGVRIETEDVSVKGFVTREELSRKVKQLMEGEMGKTTMKNVKEYAKMAKKAMAQGTGSSWKSLDSLLEELCKSREPDGVNKLSSSDA

SEQ ID NO: 983 - protein, 483 aa, Arabidopsis thaliana
MRAGDNNAANLEGGSGDSHQSDQGFFDAAFADRREDAATSGADTPRGDFIQSPFGVFLRSDEKASTKPFRDSSDESDGNSVVPKTLTSKAEEWMVKKGLSWPWKGNEREGLEGRRSHSVWPWVRNEQQKQQAYQSNSNHSVKSESQACESIKASSNEPMGYWSSSVNVNSTSSSSSCGSTSSSVMNKVDMDSDCLDYEILWEDLTIGEQIGQGSCGTVYHGLWFGSDVAVKVFSKQEYSEEIITSFRQEVSLMKRLRHPNVLLFMGAVTSPQRLCIVTEFLPRGSLFRLLQRNTSKLDWRRRIHMASDIARGMNYLHHCTPPIIHRDLKSSNLLVDKNWTVKVADFGLSRIKHETYLTTKTGRGTPQWMAPEVLRNEAADEKSDVYSFGVILWELVTEKIPWESLNAMQVIGAVGFMNQRLEVPKNVDPQWISLMESCWHSEPQDRPSFQEIMEKLRELQRKYTIQFQAARAASIENSALKEK

SEQ ID NO: 984 - protein, 767 aa, Arabidopsis thaliana
MEKTTPPAEELLKKIRELEESQEHLKREMSRLKVSAEMKQRSHSASPQRPVRRNSNDGTPMWRKTGAASFRHASPLRKESHAKVAGGGGEGQSAGKFTDKQYLNILQSMAQAVHVFDLNGQIIFWNSMAEKLYGFSASEALGKDPIDILVDVQDASVAQNITRRCSSGESWTGEFPVKNKAGERFSVVTTMSPSYDDDGCLIGIICITNDSALFQDPRGSPAKTRRGQEGETSFSRVTSSVASKLGLDSKEAVVSKLGLDSQQPIQVAIASKISDLVGNKVKSKMRAGDNNAANLEGGSGDSHQSDQGFFDAAFADRREDAATSGADTPRGDFIQSPFGVFLRSDEKASTKPFRDSSDESDGNSVVPKTLTSKAEEWMVKKGLSWPWKGNEREGLEGRRSHSVWPWVRNEQQKQQAYQSNSNHSVKSESQACESIKASSNEPMGYWSSSVNVNSTSSSSSCGSTSSSVMNKVDMDSDCLDYEILWEDLTIGEQIGQGSCGTVYHGLWFGSDVAVKVFSKQEYSEEIITSFRQEVSLMKRLRHPNVLLFMGAVTSPQRLCIVTEFLPRGSLFRLLQRNTSKLDWRRRIHMASDIARGMNYLHHCTPPIIHRDLKSSNLLVDKNWTVKVADFGLSRIKHETYLTTKTGRGTPQWMAPEVLRNEAADEKSDVYSFGVILWELVTEKIPWESLNAMQVIGAVGFMNQRLEVPKNVDPQWISLMESCWHSEPQDRPSFQEIMEKLRELQRKYTIQFQAARAASIENSALKEK

SEQ ID NO: 985 - protein, 499 aa, Arabidopsis thaliana
MARKMLVDGEIDKVAADEANATHYDFDLFVIGAGSGGVRAARFSANHGAKVGICELPFHPISSEEIGGVGGTCVIRGCVPKKILVYGATYGGELEDAKNYGWEINEKVDFTWKKLLQKKTDEILRLNNIYKRLLANAAVKLYEGEGRVVGPNEVEVRQIDGTKISYTAKHILIATGSRAQKPNIPGHELAITSDEALSLEEFPKRAIVLGGGYIAVEFASIWRGMGATVDLFFRKELPLRGFDDEMRALVARNLEGRGVNLHPQTSLTQLTKTDQGIKVISSHGEEFVADVVLFATGRSPNTKRLNLEAVGVELDQAGAVKVDEYSRTNIPSIWAVGDATNRINLTPVALMEATCFANTAFGGKPTKAEYSNVACAVFCIPPLAVVGLSEEEAVEQATGDILVFTSGFNPMKNTISGRQEKTLMKLIVDEKSDKVIGASMCGPDAAEIMQGIAIALKCGATKAQFDSTVGIHPSSAEEFVTMRSVTRRIAHKPKPKTNL

SEQ ID NO: 986 - protein, 503 aa, Arabidopsis thaliana
MGSEATTAVNNLQQPLLESTKSEADFRMESVLTDTHLSYFRRIYLASLIEMKYLFHLAAPAIFVYVINNGMSMLTRIFAGRLGSMQLAAASLGNSGFNMFTLGLMLGMGSAVETLCGQAHGAHRYDMLGVYLQRSTIVLVITGLPMTLLFIFSKPLLISLGEPADVASVASVFVYGMIPMIFAYAVNFPIQKFLQSQSIVTPSAYISAATLVIHLILSWLSVFKFGWGLLGLSVVHSLSWWIIVLAQIIYIKISPRCRRTWDGFSWKAFDGLWDFFQLSAASAVMLCLESWYSQILVLLAGLLKDPELALDSLAICMSISAMSFMVSVGFNAAASVRVSNELGAGNPRSAAFSTAVTTGVSFLLSLFEAIVILSWRHVISYIFTDSPAVAEAVAELSPFLAITIVLNGVQPVLSGVAVGCGWQAYVAYVNIGCYYIVGIPIGYVLGFTYDMGARGIWTGMIGGTLMQTIILVIVTFRTDWDKEVEKASRRLDQWEDTSPLLKQ

SEQ ID NO: 987 - protein, 551 aa, Arabidopsis thaliana
MDANFEMPPVGGMNDDDDMDFGDGASFLKVGEEKEIQQGLKKKLLKEGEGYETPENGDEVEVHYTGTLLDGTKFDSSRDRATPFKFTLGQGQVIKGWDIGIKTMKKGENAVFTIPAELAYGESGSPPTIPANATLQFDVELLKWDSVKDICKDGGVFKKILAVGEKWENPKDLDEVLVKFEAKLEDGTVVGKSDGVEFTVKDGHFCPALTKAVKTMKKGEKVLLTVKPQYGFGEKGKPASAGEGAVPPNATLEINLELVSWKTVSEVTDDNKVVKKVLKEGDGYERPNEGAVVKVKLIGKLQDGTVFLKKGHGENEEPFEFKTDEEQVVDGLDRAVMKMKKGEVALVTIDPEYAFGSNESQQELAVVPPNSTVTYEVDLLTFDKERESWDMNTEEKIEAASKKKEEGNSKFKGGKYSLASKRYEKAVKFIEYDTSFSEEEKKQAKALKVACNLNDAACKLKLKDYKQAEKLCTKVLELESTNVKALYRRAQAYMELSDLDLAEFDVKKALEIDPNNREVKLEQKRLKEKMKEFNKKEAKFYGNMFAKLSKE

SEQ ID NO: 988 - protein, 500 aa, Arabidopsis thaliana
VHATSLNNNKSHAPLILPRQRNVNAFFSLSNSSIGMGIEKRKKMVWFWPEKHEGGVIKEAEDVAAEHISREGTMSHYSFSKGLLPPLGVGATARSSRHIKLRCFIVSPFDPRYRAWDWFLVILVLYTAWASPFEFGFLQTPRAPLSILDNVVNGFFAVDIVLTFFVAFLDKATYLLVDDPKRIAWRYTSTWLIFDVVSTVPYELFGSLLHNTIQGYGIFSMLRLWRLHRVSKCFARLEKDRKYNYFWIRCTKLLLVSLFVVHCGACFCYSIAAHYPDPSMTFMALAEANWKQKSLLIRYVTAMYWSITTFSTTGYGDIHGNNAEERAFILFYMIFNLGLLAYIIGNMTNLVVHVTSRTRNFRDTIQAASAFAQRNNLPLGLQEQMVAHLSLRYRTDSEGLQQQEIIDSLPKAIRSSISHYLFYEVVDKTYLFHGISNDLLFQLVSEMKAEYFPPKEDVILRNEAPSDFYIMVTGAVDIIARVNGVDQVKSAFLFLFCDGF

SEQ ID NO: 989 - protein, 158 aa, Arabidopsis thaliana
MQSMKETASNIAASAKSGMDKTKATLEEKAEKMKTRDPVQKQMATQVKEDKINQAEMQKRETRQHNAAMKEAAGAGTGLGLGTATHSTTGQVGHGTGTHQMSALPGHGTGQLTDRVVEGTAVTDPIGRNTGTGRTTAHNTHVGGGGATGYGTGGGYTG

SEQ ID NO: 990 - protein, 314 aa, Arabidopsis thaliana
MGVREKDPLAQLSLPPGFRFYPTDEELLVQYLCRKVAGYHFSLQVIGDIDLYKFDPWDLPSKQTCFTFVGEYNCNYLGKALFGEKEWYFFSPRDRKYPNGSRPNRVAGSGYWKATGTDKIITADGRRVGIKKALVFYAGKAPKGTKTNWIMHEYRLIEHSRSHGSSKLDDWVLCRIYKKTSGSQRQAVTPVQACREEHSTNGSSSSSSSQLDDVLDSFPEIKDQSFNLPRMNSLRTILNGNFDWASLAGLNPIPELAPTNGLPSYGGYDAFRAAEGEAESGHVNRQQNSSGLTQSFGYSSSGFGVSGQTFEFRQ

SEQ ID NO: 991 - protein, 455 aa, Arabidopsis thaliana
MGGLKFHVLMYPWFATGHMTPFLFLANKLAEKGHTVTFLIPKKALKQLENLNLFPHNIVFRSVTVPHVDGLPVGTETVSEIPVTSADLLMSAMDLTRDQVEGVVRAVEPDLIFFDFAHWIPEVARDFGLKTVKYVVVSASTIASMLVPGGELGVPPPGYPSSKVLLRKQDAYTMKNLESTNTINVGPNLLERVTTSLMNSDVIAIRTAREIEGNFCDYIEKHCRKKVLLTGPVFPEPDKTRELEERWVKWLSGYEPDSVVFCALGSQVILEKDQFQELCLGMELTGSPFLVAVKPPRGSSTIQEALPEGFEERVKGRGVVWGEWVQQPLLLSHPSVGCFVSHCGFGSMWESLLSDCQIVLVPQLGDQVLNTRLLSDELKVSVEVAREETGWFSKESLFDAINSVMKRDSEIGNLVKKNHTKWRETLTSPGLVTGYVDNFIESLQDLVSGTNHVSK

SEQ ID NO: 992 - protein, 596 aa, Artemisia annua
  misc_feature (369)..(369): Xaa can be any naturally occurring amino acid
KNSLRVTSPDNLKDTYECAIGNFGVPQYGGTLTGFVEYPKSNQKACQTFDSSLKSHVSGGLPLFVLLDRGDCYFTLKAWNAQNAGAAAILVADDRAEPLITMDMPEEENARADYLQNITIPSALIAKALGDSIKKALTKGDLVNIKLDWTEALPHPDERVEYEFWTNSNDECGAKCDSQINFVKEFKGAAQILEKKGYTQFTPHYITWYCPEAFTLSKQCKSQCINHGRYCAPDPEQDFSKGYDGKDVVVQNLRQACFYKVTNETGKPWLWWDYVTDFSIRCPMKDQKYTKECAEEVIKSLGVDLKKINECVGDTEADVDNAVLKAEQEAQIGKGSRGDVTILPTLVINNRQYRGKLAKQAVLKAICSXFEETTEPAVCLSDDMQTNECLENNGGCWMDKAANITACRDTFRGRVCECPVVQGVKFVGDGYKHCEASGALRCEVNNGGCWKSTQQGRTYSACIDDHTKSCECPPGFKGDGVNSCEDIDECKEKTACQCSNCKCKNTWGSYECSCSGNLLYMREHDTCISKDGKSEVSWGFVWVIILGLAAAGTAGYAFYKYRVRTYMDSEIRAIMAQYMPLDNQAEVEIHGTHGNV

SEQ ID NO: 993 - protein, 369 aa, Artemisia annua
  misc_feature (20)..(20): Xaa can be any naturally occurring amino acid
QAPTFNAGVKLFEGEGRIVXPNEVEVIQLDGTKLSYTAKHILIATGSRAQRPDIPGQELGITSDEALSLDELPKRVVILGGGYIAVEFASIWRGMGSTVNLCFRRELPLRGFDDEMRALVARNLEGRGIILHPQTTLTKLVKTEDGIKVTTDHGEELLADAVLFATGRIPNSKRLNLQAVGVEVDKTGAVKVDEYSRTNVPSVWAIGDVTNRMNLTPVALMEGTLFAKTVFGNEPSKPDYSNIPCAVFCIPPLSVVGLSEEQAIEQADGDILVFTSGFNPMKNSISGRQEKTLMKLIVSAETDKVLGASMCGPDAAEIMQGIAVALKCGATKAQFDSTVGIHPSSAEEFVTMRSVTRRIAAAGKPKTNL

SEQ ID NO: 994 - protein, 195 aa, Artemisia annua
MSFQDLEAGRVRRSNNGYTNGFKQMDPTQAIASGIFQINTGVNTFQRLVNTLGTPKDTPELRDKLHKTRLHIGQLVKDTSDKLKKASETDHRAEVSASKKITDAKLAKDFQAVLKEFQKAQRLAAERETAYVPFVPQAVLPSSYAASEMDVRSDKDPEQRALLVESRRQEVLLLDNEIAFNEAIIEERDQGIQEI

SEQ ID NO: 995 - protein, 446 aa, Artemisia annua
VTNYYSNHYAIIILLATNSKMRVERSAFQFKFMALVLLLVLFSFLNLASSEIIFEERFDDGWQSRWVKSDWKKSEGKAGSFKHTAGSWSGDPDDKGLQTTTDARHFAISAKIPEFNNKNRTLVLQYSVKIEQDIECGGAYIKLMSGYVNQKKFGGDTPYSVMFGPDICGTQTKKLHVILSYQGQNYPLKKDLQCETDKLTHFYTFVLRPDASYSILIDGRERDSGSMYTDWDILPPRKIKDVTAKKPADWEEREYIEDPNQVKPEGYDSIPREIPDPKAKQPDTWDEDEDGIWRAPKIPNPAYKGPWKPKKIKNPNYKGKWKTPWIDNPEFEDDPDLYVLKPIKYVGIEVWQVKAGAVFDNILICDDPEYAKDVVQEVFTNREMEKEALEEAEKIKKAREEEEAQRAREEGEKRKRERGYDRRRRDKDHYRDRYRKRHYDDYHDEL

SEQ ID NO: 996 - protein, 134 aa, brassica juncea
  misc_feature (73)..(73): Xaa can be any naturally occurring amino acid
METEKKNSKELGLNHLGFVRVAAIQVLVSLSNLYDYAKQNSGPLKPAVGKVEGAVTTVVTPVFNKFKDVPDTXLLFLDHKVGEVSNKFDKHAPPLAKQVVSQAHVLIQMTTEKAQSFVKEARTGGPKAAFNYAE

SEQ ID NO: 997 - protein, 152 aa, brassica juncea
  misc_feature (26)..(26): Xaa can be any naturally occurring amino acid
  misc_feature (54)..(54): Xaa can be any naturally occurring amino acid
  misc_feature (68)..(68): Xaa can be any naturally occurring amino acid
MQSMKETASNIAASAKSGMDKTKATXEEKAEKMTTRDPIQKEMATQKKEGRINXAEMQKREAREHNAXMKEAAGAGTGTGLGLGSATHSTTGHVGHGTGTHQMSALPGHGTGQPTGHVVDGTAETEPIGTNTGTGRTTAHNTRVGGGTTGYG

SEQ ID NO: 998 - protein, 449 aa, brassica juncea
KTMKKGENAVFTIPSELAYGESGSPPTIPANATLQFDVELLSWSSVKDICKDGGVFKKIVAAGEKWETPKDLDEVLVKYEAKLEDGTVVGKSDGVEFTVKDGYFCPALAKAVKTMKKAEKVLLTVKPQYGFGEKGKPASGAEAAVPPNATLEIELELVSWKTVSEVTDDNKVIKKILKEGEGYERPNEGAVVKVKLIGKLGDGTVFLKKGHGESEELFEFKTDEEQVIDGLDRALMKMKKGEVALVTIDPEYAFGSTESKQELAVVPPNSTVYYEVDLVSFDKERESWDMNTEEKIEAAGKKKEEGNAKFKAGKYALASKRYEKAVKFIEYDSSFSEEEKKQAKALKVACNLNDAACKLKLKEYRQAEKLCTKVLELESTNVKALYRRAQAYMELADLDLAEFDVKKALEVDPDNREVKVEQRRLKEKMKEFNKKEAKFYGNMFAKLSK

SEQ ID NO: 999 - protein, 434 aa, brassica juncea
IGGVGGTCVIRGCVPKKILVYGATYGGEFEDARNYGWEINENVDFTWKKLLQKKTDEILRLNNIYKRLLANAAVKLYEGEGRIVGPNEVEVRQIDGTKISYTAKHILIATGSRAQKPNIPGHELAITSDEALSLEEFPKRAVVLGGGYIAVEFASIWRGMGGTVDLFFRKELPLRGFDDEMRALVARNLEGRGVNLHPQTSLTQLTKTDEGIKVISSHGEEFMADVVLFATGRNPNTKRLNLEAVGVELDQAGAVKVDEYSRTNIPSIWAVGDATNRINLTPVALMEATCFANTVFGGKPTKADYTNVACAVFCIPPLAVVGLSEEEAVEKATGDILVFTSGFNPMKNTISGRQEKSLMKLIVDEQTDKVIGASMCGPDAAEIMQGIAIALKCGATKAQFDSTVGIHPSSAEEFVTMRTVTRRIAYKAKPKTSL

SEQ ID NO: 1000 - protein, 82 aa, brassica juncea
LEEKAEKMTTRDPLQKEMATQKKEGRINEAEMQKGEAREHNAVMKEASGAGTGTGLGMGTATHSTTGHVGHGTGTHQMSALP

SEQ ID NO: 1001 - protein, 550 aa, Brassica oleracea
MDEDFEMPPVGGMNGDDEMDFGDDASFLKVGEEKEIQQGLKKKLLKEGEGFETPENGDEVEVHYTGTLLDGTKFDSSRDRGTPFKFTLGQGQVIKGWDIGIKTMKKGENAVFTIPSELAYGESGSPPTIPANATLQFDVELLSWSSVKDICKDGGVFKKIVAAGEKWETPKDLDEVLVKYVAKLEDGTVVGKSDGVEFTVKDGYFCPALAKAVKTMKKAEKVLLTVKPQYGFGEKGKPASAGEAAVPPNATLEIELELVSWKTVSEVTDDNKVIKKILKEGEGYERPNEGAVVKVKLIGKLGDGTVFLKKGHGEGEEPFEFKTDEEQVIDGLDKALLKMKKGEVALVTIDPVYAFGSTESKQELAVVPPNSTVYYEVDLVSFDKERESWDMNTEEKIEAAGKKKEEGNAKFKAGKYALASKRYEKAVKYIEYDSSFSEDEKKQAKALKVACNLNDAACKLKLKEYRQAEKLCTKVLELESTNVKALYRRAQAYMELADLDLAEFDVKKALEVDPDNREVKVEQRRLKEKMKEFNKKEAKFYGNMFAKLSK

SEQ ID NO: 1002 - protein, 204 aa, Brassica oleracea
  misc_feature (184)..(184): Xaa can be any naturally occurring amino acid
METEKNSKELGLNHLGFVRVAAIQVLVSLSNLYDYAKQNSGPLKPAVGKVEGAVTTVVTPVFNKFKDVPDTLLLFLDHKVGEVSNKFDKHAPPLAKQVVSQAHVLIQATTEKAQSFVKEARTGGPKAAFNYAAAEYKYFVVTNSVKVWAKLNQYKPIHAVGNKALPLAANLSGMYNDLVTNMTXMGYPVVGYLPLVPVDDIVKA

SEQ ID NO: 1003 - protein, 139 aa, Brassica oleracea
  misc_feature (10)..(10): Xaa can be any naturally occurring amino acid
  misc_feature (77)..(77): Xaa can be any naturally occurring amino acid
KQVVSQAHVXIQATTEKAQSFVKEARTGGPKAAFNYAAAEYKYFVVTNSVKVWAKLNQYKPIHAVGNKALPLAANLXGMYNDLVTNMTKMGYPVVGYLPLVPVDDIVKAYEKEQDAAQKKGDTTPATDGNKSSFDSDTD

SEQ ID NO: 1004 - protein, 151 aa, Brassica oleracea
MASLLDKAKDFVADNLAGVPKPEGSVTDVDLKDVNRDSVEYLAKVSVTNPYGHAIPICEINFTIHSGGREIGKGKIPDPGSLKAKDMTVLDVPIVVPYSILFNLARDVGADWDIDYLLEIGLSIDLPVLGDFTIPVTSKGEIKLPTFKDYF

SEQ ID NO: 1005 - protein, 500 aa, Brassica oleracea
MGRKMLADGELDKAVAAEEATETHYDFDLFVIGAGSGGVRAARFSANNGAKVGICELPFHPISSEEIGGVGGTCVIRGCVPKKILVYGATYGGELEDARNYGWEINENVDFTWKKLLQKKTDEILRLNNIYKRLLANAAVKLYEGEGRIVGPNEVEVRQIDGTKISYTAKHILIATGSRAQKPNIPGHELAITSDEALSLEEFPKRAVVLGGGYIAVEFASIWRGMGGTVDLFFRKELPLRGFDDEMRALVARNLEGRGVNLHPQTSLTQLIKTDDGIKVISSHGEEFMADVVLFATGRNPNTKRLNLEAVGVELDQAGAVKVDEYSRTNIPSIWAVGDATNRINLTPVALMEATCFANTVFGGKPTKADYSNVACAVFCIPPLAVVGLSEEEAVEKATGDILVFTSGFNPMKNTISGRQEKSLMKLIVDEQTDKVIGASMCGPDAAEIMQGIAIALKCEATKAQFDSTVGIHPSSAEEFVTMRTVTRRIAYKAKPKTSL

SEQ ID NO: 1006 - protein, 434 aa, Brassica rapa
  misc_feature (179)..(179): Xaa can be any naturally occurring amino acid
MSILTRIFAGNVGSSQLAAASLGNSGFNMFTYGLLLGMGSAVETLCGQAHGAHRYEMLGVYLQRSTVVLIITCLPMSLLFIFSKPLLNTLGEPEQVASMASVFVYGMIPVIFAYAVNFPIQKFLQAQSIVTPSAYISAATLVIHLVLSWIAVYRLGFGLLALSLIHSLSWWIIVAAQIXYIKMSPRCQRTWEGFSWKAFEGLWDFFRLSAASAVMLCLESWYSQILALLAGLLKNPELALDSLAICMSISAISFMVSVGFNAAASVRVSNELGAGNPRAAAFSTFVTTGVSLLLAVFEAVVVMSWRNVISYAFTDSPEVAEAVADLSPFLAITIVLNGVQPVLSGVAVGRGWQAFVAYVNIGCYYVVGIPIGFILGFTYDMGAKGIWTGMIGGTLMQTIILVIVTFRTDWDKEVEKASSRLDRWEESREPLLKQ

SEQ ID NO: 1007 - protein, 188 aa, Brassica rapa
YDSSLEQDIASSVPFPLAKLLVTLATSFRYDKEKVDKEVATIEAGMLHEAISKKQLDHDHVLYIIGTRSIYQLRATFVAYKQSYGNTLDKDVDGCPGDADLRSLLQMVILCIEFPEKHFAKVVRDSIEGFGTDEDSLTRAIVMRAEIDLMKVRGEYFNMYNASMDNAIIGDVSGDYKDFLMTLLGSKI

SEQ ID NO: 1008 - protein, 156 aa, Brassica rapa
  misc_feature (101)..(101): Xaa can be any naturally occurring amino acid
  misc_feature (105)..(105): Xaa can be any naturally occurring amino acid
  misc_feature (118)..(118): Xaa can be any naturally occurring amino acid
MGVREMDPLAQLSLPPGFRFYPTDEELLVQYLCRKVAGYHFSLQVIGDIDLYKFDPWDLPSKALFGEKEWYFFSPRDRKYPNGSRPNRVAGSGYWKATGTXKIIXSDGHRVGIKKALXFYAGKAPKGTKTNWIMHEYRLIEHSRSHGSSKVTTTHY

SEQ ID NO: 1009 - protein, 236 aa, Brassica rapa
METEKKNSKELGLNHLGFVRVAAIQVLVSLSNLYDYAKQNSGPLKPAVGKVEGAVTTVVTPVYNKFKDVPDTLLLFLDHKVGEVSNKFDKHAPPLAKQVVSQAHVLIQMTTEKAQSFVKEARTGGPKAAFNYAATEYKYFVVTNSVKVWVKLNQYKPIHAVGNKALPLAANLSGKYNGLVTDMTKIGYPVVGYLPLVPVDDIVKAYEKEQDAAQKKGDTTTTPTDGNKSSSDSDTD

SEQ ID NO: 1010 - protein, 224 aa, Brassica rapa
  misc_feature (12)..(12): Xaa can be any naturally occurring amino acid
MIARILAGFMEXPAVAAAGDSVLGTIKIAVMPIAKVFTMCFLGLLMASKYVNILPPSGRKLLNGLVFSLLLPCLIFSQLGQAVTLQKMLQWWFIPVNVVLGTISGSLIGLLVATIVRPPYPYFKFTIIQIGVGNIGNVPLVLLAALCRDTSNPFGDSEKCSIDGTAYISFGQWVGAIILYTYVYQMFTPPPEGFDGEEENLPLKNAASPEQVPLLTHNYPKDTP

SEQ ID NO: 1011 - protein, 422 aa, Brassica rapa
  misc_feature (98)..(98): Xaa can be any naturally occurring amino acid
  misc_feature (406)..(406): Xaa can be any naturally occurring amino acid
MNGGHLPTAASDDLKSPLLPVVHNDEPFEKQTLGHHLRTIFTPKNCYIALGPLLCAVVCLCARLGGEDTTTAKNMLGVLVWMFAWWLTEAVPMPITSXSPLFLFPLFGITTADHVASSYMDDVISLVLGSFILALAVEHYNIHRRLALNITMVFCVEPLNAPLLLLGICATTAFVSMWMHNVAATVMMMPVATGILQRLPSSPSSSSEMVPPAVGKFCRAVVLGVIYSAVVGGMSTLTGTGVNLILVGMWKSYFPEADPISFSQWFFFGFPLALCLFVVLWGILCVLYCPKGSGKLLSPYLHKSHLRTELEMLGPMSFAEKMVLSVFGGLVVLWMTRNITDDIPGWGCIFNGRVGDGTVSVMMATLLFIIPNGIKKGEKLMDWGKCKKLPWNIVLLLGAGFAIADXVRTSGLAEVLSKGLVF

SEQ ID NO: 1012 - protein, 340 aa, Brassica rapa
MDEDFEMPPVGGMNGGDEMDFGDDASFLKVGEEKEIQQGLKKKLLKEGQGFETPENGDEVEVHYTGTLLDGTKFDSSRDRGTPFKFTLGQGQVIKGWDIGIKTMKKGENAVFTIPSELAYGESGSPPTIPANATLQFDVELLSWSSVKDICKDGGVFKKIVAAGEKWEMPKDLDEVLVKYVAKLEDGTVVGKSDGVEFTVKDGYFCPALAKAVKTMKKAEKVLLTVKPQYGFGEKGKPASGGEAAVPPNATLEIELELVSWKTVSEVTDDNKVIKKILKEGEGYERPNEGAVVKVKLIGKLGDGTVFLKKGHGDGEEPFEFKTDEEQVIDGLDKALLKMK

SEQ ID NO: 1013 - protein, 212 aa, Brassica rapa
  misc_feature (21)..(21): Xaa can be any naturally occurring amino acid
  misc_feature (41)..(41): Xaa can be any naturally occurring amino acid
  misc_feature (52)..(52): Xaa can be any naturally occurring amino acid
  misc_feature (58)..(58): Xaa can be any naturally occurring amino acid
MATIRVPDEVPSAAQDSETLXQAFRGWGTDEKAIIRVLGKXNESQRKRIREXYREIYXKDLIDVLTSELSGDFMKAVVLWTYVPAERDARLANNVLNGKKKSIEKLKIIVEISCTTSPNHLIAVRKAYCSLFDLSLEEHIASSVPFPLAKVLVTLATSFRYDKDMADTEVATIEAGMLREAITAKQLDHDHVLYILGTRSIYQLRETFVAYK

SEQ ID NO: 1014 - protein, 502 aa, Brassica rapa
MARKMLSDGELNKAAAAGEEATTETHYDFDLFVIGAGSGGVRAARFSANNGAKVGICELPFHPISSEEIGGVGGTCVIRGCVPKKILVYGATYGGELEDARNYGWEINGNVDFNWKKLLQKKTDEILRLNNIYKRLLANAAVKLYEGEGRIVGPNEVEVRQIDGTKISYTAKHILIATGSRAQKPNIPGHELAITSDEALSLEEFPKRAIVLGGGYIAVEFASIWRGMGATVDLFFRKELPLRGFDDEMRALVARNLEGRGINLHPQTSLAELIKTDDGIKVISSHGEEFVADVVLFATGRIPNTKRLNLEAVGVELDQAGAVKVDEYSRTNIPSIWAVGDATNRINLTPVALMEATCFANTVFGGKPAKADYTNVACAVFCIPPLAVVGLSEEEAVEKATGDILVFTSGFNPMKNTISGRQEKSLMKLIVDEKTDKVIGASMCGPDAAEIMQGIAIALKCGATKAQFDSTVGIHPSSAEEFVTMRTVTRRIAYKAKPQTSL

SEQ ID NO: 1015 - protein, 301 aa, Brassica rapa
  misc_feature (101)..(101): Xaa can be any naturally occurring amino acid
  misc_feature (105)..(105): Xaa can be any naturally occurring amino acid
  misc_feature (118)..(118): Xaa can be any naturally occurring amino acid
  misc_feature (211)..(211): Xaa can be any naturally occurring amino acid
MGVREMDPLAQLSLPPGFRFYPTDEELLVQYLCRKVAGYHFSLQVIGDIDLYKFDPWDLPSKALFGEKEWYFFSPRDRKYPNGSRPNRVAGSGYWKATGTXKIIXSDGHRVGIKKALXFYAGKAPKGTKTNWIMHEYRLIEHSRSHGSSKLDDWVLCRIYKKTSGSQRQAVASPVQACLEDQSTNMSSSPSSSSQLDDVLDSFPEMKDRSXDLPRMNSLRTILNGNFEWASLAGLNPMPELAPMTYGLSNYGGYHAFQSAESGCRSSQVDQEQNSTELTQSLGYSSSGFGLSGQMYEFRQS

SEQ ID NO: 1016 - protein, 314 aa, Brassica rapa
VNTLASLQHQNLCKLVGYHARDGSDTRMLVYERLALGSLDRLLHGRSDGPPLDWNTRMKIALCAAQGLTFLHEEGPFQAMYNEFSTANIQVDKDFSAKLSGYGCVGHAPETETSNSSALANLSVETLERGVLTPKSNVWSYGIVLLEMLTGRKNMDGSYPKEERNLVKWSRAFLADDCRLSLIMDPQLKGRFPAKAARSIADIAQRCLQAEPSERPTMRNIVDQLKIIQDMKYSCRFPLREPAPAAVRKHMGRSSSLNTIVWTPGVAGAAPRSSFSPSPPARRPSVSPTRGRGLAFRPVFPARVCSSLEEMSRE

SEQ ID NO: 1017 - protein, 210 aa, Brassica rapa
METDKKNSQELGLKHLGFVRVAAIHVLVSLSSLYDYAKQNSGPLKPAVGKVEGAVTTVVTPVYNKLKNVPDTLLLFLDHKVGEASDKFDKHAPPVAKKVVSRANVLIQTTTEKAQRFVKEARTGGPRGAFNYAAAEYKCFLVTNSVRVWAKLNRFKPIHAVGNKAFPVAAHVSGIYNDLVTDMTQMGYPVVGYLPLVPVDDIVKAYEKEE

SEQ ID NO: 1018 - protein, 442 aa, Brassica rapa
MGRKSQRKNVPMDLFDSDDDTSSISSSSTMRSERPGMDDVQVHKDLMLDQSLDALYEKRTSTREQALASIVDAFNSDLQHEFVEKKFATLLHQCLHCTKKGSSKETSLASHVIGLLALTVGLGDQAQEILEESVTPLSQALKSGREVLKITSILECLAVITFVGGTNPEQTETSMQIIWQMIHPKLGSNVVAAKPSPAVITTVVSSWAFLLTTVDRWTLSPKLWQEIVTYLSSLLEKDDRSVRIAAGEALALIFESGTLEKFAAEAKESANNGSVKEGSVSQEALIHMHGLKSKVVNQVRDLSVEAGGKGSAKKDLNTQRNLFKDLVEFLEDGYAPETSTKVGGDYLQTTTWYQMIQLNFLKHFLGGGFIKHMQENEFLHDVFSFTPKKVGGRGSGMSSEEKRMFKSPNSALNKARTQFLNKQRMLAKNMNDGHYAATVENE

SEQ ID NO: 1019 - protein, 65 aa, Brassica rapa
MTVLDVPIVVPYSILFNLARDVGADWDIDYLLEIGLTIDLPVVGDFTIPVTSKGEIKLPTFKDYF

SEQ ID NO: 1020 - protein, 130 aa, Hordeum vulgare
GSTPPATSPPTHPSSPEKRASETQEEVQKRNLMDELEERERKHFSSKDKSYVDERDRRKSSSLLLEGSKRDEDKIVPREIDADDSDVELKSDDESDDDDDDDDTEALMAELERIKKERADDRFRKERQPA

SEQ ID NO: 1021 - protein, 588 aa, Hordeum vulgare
  misc_feature (40)..(40): Xaa can be any naturally occurring amino acid
  misc_feature (44)..(44): Xaa can be any naturally occurring amino acid
MSEQPLPQPRSSMREALQKEDKEKASSAAPPAKEKAAVAXPHVXAPPMAKNGGGGGKGGNGGQPPAPEETTREIQVVREAYRQPAAPAYVMPEEPPAMVELVGWYLYGFCSFFITHLLLPVLFPAIVTQVAFPSSDFNPEAKYTVKGASCSVHEMSMYQRLTRYTIAISSSHMSPLGWSALSWAIGILLVAPLLTQVAHHLDRGQYQSLILIAATSFGSFFCLLTGFFKTVWVFLFYILFIAASIIIAEAVHTRNLGLMIRGLAAHDSGKHLVLRRRAAASQLSLYCTAIGGIGAALMAAFMYHMLRRTDQLTGLWVVSIFSGLIWFIGICHGLFTNRPSSSSPTTAFEPNFFSKLRYSMTIGRYPQAIGSLVAVFLSSFATMCIFTSGTLYAIGGVCIKPVLVLALWILYFLFPLISLPLLHPIQIIIRADAVRMQLLGFIIALFVSGAGFYFKSHRWRAAHIIIIALVQSTANGILYSFGRILLLDASPPGKEGAFAIWYAYVRCMGAMIGFAVASAGPGRAGGSFAAAFLGSFLGIIVLIFGNVSNIGALKAAGHLKGMEDEKRIGEKGEGMSAVADSGESRGRV

SEQ ID NO: 1022 - protein, 229 aa, Hordeum vulgare
MNIFRKKVDPKEALRTSKREMSVATRGVEREIGSLQMEEKKLVAEIKKTAKTGNEAATKILARQLVRLRQQIVNLQGTRAQIRGVATHTQAMYAGTSISAGMKGASKAMAAMNKQMEPTKQMKQMREFQKQSSQLDMTLEMMSDAIDETLDKDEAEEETEELTNQVLDEIGVDVASQLSSAPKGRIGASTKKAENNQARNAAPAKNVAPEPNAAEVDDLERRLASLRRI

SEQ ID NO: 1023 - protein, 279 aa, Hordeum vulgare
STSSTMSSTVSSNSSPIERVDYDSDCLDYEILWEDLTLGEQVGEGSCGTVYHALWYGSDVAVKVFSRQEYSEEMIRTFRQEVSLMKKLRHPNIILFMGAVASQERLCIVTEFLPRGSLFRLLRKTTGKLDPRRRVHMAIDIARGMNYLHSSSPTIVHRDLKSSNLLVDKNWTVKVADFGLSRLKIETFLTTKTGKGTPQWMAPEVLRNEPSNEKSDVYSYGVVLWELVTQKIPWDTLNTMQVVIGCKIHLRYNLLRYRKKFNIFCLIYPPISLSIGRQD

SEQ ID NO: 1024 - protein, 379 aa, Hordeum vulgare
YWIHSALPHSGYNHPPALISSSSSSLPPTTPAMATAAACASSLLAPPSASCAGTAASGALFPTSVPSLRAYPRLLLAFRRPAAAAVADPQGAAVLEEEDDETPVQFDDVDDDYEDGYGGRGPAFTAPTRPRTGKAALPLKRDRTRSKRYLEIQKLRESKKEYDVPMAISLMKQVANTRFVESAEAHFRMNLDPKYNDQQLRATVNLPKGTGQTVKIAVLTQGEKIDEARAAGADIVGSDDLIEQIKGGFMEFDKLIASPDMMPKVASLGKILGPRGLMPNPKAGTVSPNITQAIDEFKKGKVEFRVDKTGIAHIPFGKVNFPEEDLIANFMAVVRSIERNKPSGAKGIYWKTAYVCSSMGPSIKLNIKEMLDYGADSSN

SEQ ID NO: 1025 - protein, 201 aa, Hordeum vulgare
  misc_feature (201)..(201): Xaa can be any naturally occurring amino acid
LPRGSLFRLLRTNIGKLDPRRRVNMAIDIARGMNYLHNSTPTVVHRDLKSPNLLVDKNWTVKVADFGLSRLKLETFLTTKTGKGTPQWMAPEVLRSEPSNEKSDVFSYGVVLWELVTQKIPWDTLNTVQVVGAVGFMDDRLEIPRDTDPQLASMIQSCWDSDPQCRPSFQELLERLQELQKQYTIQVQTEPKKRVGKVPEX

SEQ ID NO: 1026 - protein, 179 aa, Ocimum basilicum
MSFQDIEAGRSNGSRRGYANGKQDPTQAVVSGIFQINTAVSTFQRLVNTLGTPKDTPELREKLRKTRLHIGQLVKDTSDKLKQASEIDHHAEVSASKKITDAKLAKDFQAVLKEFQKAQRLAAERETAYTPFVPQAVLPSSYSAGDMDVSADKAPEQRLLLESKRQEVLLLDNEIAFNE

SEQ ID NO: 1027 - protein, 502 aa, Phaseolus vulgaris
MARKMLIDGEAELVPGVEQGMNFDFDLFIIGAGSGGVRAARFSSNYGAKVGICELPFHTISSETIGGVGGTCVIRGCVPKKILVYGASYGGELEDARNYGWELSEKVDFNWKKLLQKKTDEINRLNGIYKRLLSNAGAKLFEGEGKIVGPNEVEVTQLDGTKLSYSAKHILIATGSRAQRPNIPGQELGITSDEALSIEDLPKRVVILGGGYIAVEFASIWRGMGSEVHLVFRKELLLRGFDDEMRTVVARNLEGRGINLHPRTNLTQLIRTENGIKVITDHGEELIADVVLFATGRAPNSKRLNLEAVGVELDKAGAIKVDEYSRTSIPTIWAVGDVTNRMNLTPVALMEASCFAKTVFNGQTSKPDYSNIACAVFSIPPLSVVGLSEEEAIEQTKGDLLIFTSSFNPMKNTTKGRQEKTERKTVMKLIVEAETDKVLGASMCGPDAPEIIQGIAIALKCGATKAQFDSTVGIYPSASEEFVTMRTVTRTVTGNGKPKTNL

SEQ ID NO: 1028 - protein, 470 aa, Phaseolus vulgaris
MEEDFNIPGGEEMDLGEVKVGEEREIGSNGLKKKLLKEGQGWETPEVGDEVKVHYTGTLLDGTKFDSNRDRDSPFSFTLGQGQVIKGWDEGIKTMKKGENAIFTIPPELAYGESGSPPTIPPNATLQFDVELLSWTSVKDICKDGGIFKKILTEGEKWENPKDPDEVLVKYEAHLEDGKLVGKSDGVEFTVREGHYCPALSKAVKTMKKGEKVVLTVKPQYGFGEKGKPAQGEEGAVPPNASLEITLELVSWKTVSEVTDDKKVIKKIVKEGEGYERPNEGASVKVKLIGKLQDGTAFLSKGHDGEEKLFEFKTDEEQVVDGLDRAVLTMKKGEVALLTIEPEYAFGSSESQQDLAVVPSNSTVYFEVELVSFEKEKESWDLNTEEKLEAAGKKKEEGNVLFKAGKYVRASKRYEKAVKHIEYDSSFGEEEKKLAKTLKVACNLNNAACKLKLKDYKEAEKLSTKVLDLE

SEQ ID NO: 1029 - protein, 227 aa, Phaseolus vulgaris
MTTAARPTWAPAKGGNEQGGTRIFGPSQKYSSRDIASHTTLKPRKDGQDTQDELKRRNLRDELEDRERRHFSSKNKSYDDRDHGKGSHLFLEGSKREIEDHIVPRSVDADDSDVEVKSDDESDDDDDDEDDTEALLAELEQIKKERAEEKLRKERQQQEEELKVKEAELLRGNPLLNNPTSFNVKRRWDDDVVFKNQARGETKIAKRFINDTIRNDFHRKFLHKYMK

SEQ ID NO: 1030 - protein, 273 aa, Phaseolus vulgaris
MSFQDIEAGRPFGSRRGLANGKQDPTQAVAAGIFQINTAVSTFQRLVNTLGTPKDTPDLREKLHKTRLHIGQLVKDTSAKLKQASDIDHHAEVNASKKIADAKLAKDFQAVLKEFQKAQRLAVERETAYTPFVPQAILPSSYTAGELNVGSDKSPEERALLVESRRQEVLFLDNEIAFNEAIIEERDQGIQEIQQQIGEVNEIFKDLAVLVHEQGTMIDDIGSNIENSHAATAQAKSQLLKASKTQRSNSSLTCLLLVIFGIVLLIVIIVLAA

SEQ ID NO: 1031 - protein, 161 aa, Beta vulgaris
MSFQDLEAGRRPLASRRDLINVKQQQDPTQAIASGIFQINTSVSSFQRLVNTLGTPKDTPQLREKLHKTRLHIGQLVKDTSAKLKQASETDHEYNVSASKKIADAKLAKDFQAVLKEFQKAQRLAAERETAYSPFVPQAVLPSSYTASEIDVSSDKTPEQR

SEQ ID NO: 1032 - protein, 151 aa, Beta vulgaris
MGVQDKDPLAQLSLPPGFRFYPTDEELLVQYLCRKVAGHQFSLQIIAEIDLYKFDPWVLPSKAMFGEKEWYFFSPRDRKYPNGSRPNRVAGSGYWKATGTDKIITTQGRKVGIKKALVFYIGKAPKGTKTNWIMHEYRLTEPTRKSGSSKL

SEQ ID NO: 1033 - protein, 93 aa, Beta vulgaris
RFLSLRLKSAILQFFSLKMAATETKPATEEAKMDLFEDDDEFEEFEIDLEWDSKEEGKEVTQQWEDDWDDDDVNDDFSLQLRRELESNAVEKK

SEQ ID NO: 1034 - protein, 143 aa, Beta vulgaris
MTTAARPTWAPAKGGNEQGGTRIFGPSQKYSSRDLAAHTNLKPRRDGQDTQDEVQKRNLRDELEDRERRHFSSKDKPYGEDRDRRKGGHLLLEGSKRDAEDRIAPRNVDADDSDVDDKSDDESDDEDDDDEGDTEALLAALEQ

SEQ ID NO: 1035 - protein, 314 aa, Brachypodium distachyon
STSSTMSSTVSSTSSPIERADYEADCLDYDILWEDLALGEQVGHGSCGTVYHALWYGSDVAVKVFSKQDYSEEMIQTFRQEVSLMKKLRHPNIILFMGAVASQQRLCIVTEYLPRGSLFSLLRRTTGKLDPRRRIHMAIDIARGMNYLHNCSPTIVHRDLKSSNLLVDKNWNVKVADFGLSRLKVETFLSTKTGKGTPQWMAPEVLRNEPSNEKSDVYSFGVVLWELVTEKIPWDNLNIMQVIGAVGFMDQRLEIPSGMDPQWASMIESCWDSDPQRRPSFQELLERLRGMQKQYALQRKMAGKGAEKVIDEDC

SEQ ID NO: 1036 - protein, 225 aa, Brachypodium distachyon
PNPILLTRSQAQHHQPAAAMGSASRAVSCLCCPCKCLACGLFSCLCSILVSLLVTAGVLALILYFIFRPHMIAATVDSAALTQFALAPNSALSYNLTVAMTVRNPNKRVGLYYDGVEALALFEGQRFGYAPLDSFSQGTDAVTELKPGFHGQQPVQGDVTAANFRAQQSAGAFDVEVKLNAKLRVKVWAFKVPGPRARISCPISVPAPGNASAPAFQPTGCKVWF

SEQ ID NO: 1037 - protein, 229 aa, Brachypodium distachyon
MTTAARPTWAPAKGGNEQGGTRIFGPSGKYSSRDLAAHTSLKPRKEGQQTQEELQKRNLRDELEERERKHYSSKDKSYVEDRDRRKSSSLLLEGSKRDAEDKIVAREIDADDSDMEPKSDDESDEDDDDDDTEALMAELERIKKERAEDKLRKERQQAEEEAKMKEAELMRGNPLINMNNSGSFNVKRRWDDDVVFKNQARGEIKTPKRFINDTIRSDFHRKFLHRYMK

SEQ ID NO: 1038 - protein, 275 aa, Brachypodium distachyon
MAPRFLACFGSRGGSATASAPDNPAEQADDQQQQLPPGPVLVELFSSQGCGASPEADAVAARLAQDAAEEGGAGERAVVVLGFHVDYWDYRGWKDPFASSAWTVRQKAYVEALQLDTLFTPQVVVQGRAHCVGTEQDKLAQAVRDAPRYPSPAMKVTFQRPNPGTLQATFKGALRARVDGGDGSVLVALYESGVVTDCGRGENKGKSLLNDHVVRRLEKVAAVRDGASAKKTVSGSVQFPLWDGFRATKCGLVLFVQNAKLHVLGVQHFDLPDNV

SEQ ID NO: 1039 - protein, 66 aa, Brachypodium distachyon
AAEAAKMDLLEDDDEFEEFEVDQEWDDKEDGDEAVQQWENDWDDDDVNDDFSLQLRKELESYSSKN

SEQ ID NO: 1040 - protein, 75 aa, Brachypodium distachyon
MAAAPADAKAEAAKMDLLEDDDEFEEFEIDQEWDDKEDGNEVVQQWEDDWDDDDVNDDFSLQLRKELEEGSAQKS

SEQ ID NO: 1041 - protein, 118 aa, Brachypodium distachyon
MTMRPVILVALAAVLTAGVMLEGGAEAAGECGRSSPDRMALRMAPCISAADDPNSAPTSSCCSAVHTIGKSPSCLCAVMLSNTANMAGIKPEVAITIPKRCNMADRPIGYKCGDYTLP

SEQ ID NO: 1042 - protein, 123 aa, Brachypodium distachyon
AEVVMFDGYIIVYKFIQDLHFFVTGGDEENELILASVLQGFSDAVGLLLRNNVDKRTALENLDLIFLCLDEVVDGGIVLETDANLIAEKVSGHGLEGAGSFTEQTISQALATAREHFARSLLK

SEQ ID NO: 1043 - protein, 526 aa, Brachypodium distachyon
MAAASTTDGGVGAILTAGERDYLVRNSGEQVKISSIEAGTVALYFSASWCPPCRRFTPKLIEAYKELASQGKSFEVVFVSGDQDEEAFNAYFAKMPWLAVPFTDSEGRKSLDERFQVRGIPHLVILDAKTGKVCTEDGVEFVSEYGIDAYPFTPERINELKEQEKAAKDNQTIHSVLSAPTRDYLISNKGDKVPISDLEGKYVGLCFVVSGYGPVEEFTTVLAKIYGKLKEVGKKFEVVAVSMDNDEASFNESFQNMPWLAIPQGDKMCQKLVSYFELNDLPTLVLIGPDGKTLNSNIADIIEENGVESWEGFPFNAEKLEILAEKARAKAESQTLQSLLVTGDLDFVIGKDGAKVPVSQLVGKTVLLYFSAQWCGPCRAFLPTLVDVYNKIKEKNSDFEIVFISSDRDQSSFDDFFSGMPWLALPLEDERKAYLKKMFKIRGIPSLVAIGPSGKTVNTDAKAPLAVHGADAFPFTEEKIQELEKNIDEMAKGWPEKLKHELHEEHELVLTRHRRPFGCDGCDEMG

SEQ ID NO: 1044 - protein, 229 aa, Brachypodium distachyon
MNIFKKKVDPKEALRTSKREMSVATRGVEREIGSLQMEEKKLVAEIKKTAKTGNEAATKILARQLVRLRQQIVNLQGTRAQIRGVATHTQAMYAGTSISAGMKGASKAMAAMNKQMEPAKQMKVMREFQKQSTQLDMTLEMMSDAIDETLDKDEAEEETEELTNQVLDEIGVDVASQLSSAPKGRIGSSNKKAESNQARNAAPARNAAPESNAAEVDDLEKRLASLRRI

SEQ ID NO: 1045 - protein, 581 aa, Brachypodium distachyon
ELHLWKWELLVFVLICGRLVSGWVIRIAVFCVERNFVLRKRVLYFVYGVRGAVQNSLWLGLVLASWHFLFDENVQRETNTPVLPYVTKVLFCLLVATLIRLVKTLLLKVLASSFHVSTYFDRIQEALFNQYVIETLSGPQLVDEDYVLAEVCELQRAGAVIPKELRAAMPTKNLLPQRSIRISGLISKGGSKQLSKEKKEREIDEGITIDKLHRLNQKNVSAWNMKRLMKIVRFGTLTTMDEQIQQATGEGDESATQIRSEYEAQIAAKKIFNNVAKPGSKYIYLADLMRFMRQEEAIKAMHLFEGAQEHCRVSKRSLKNWVVTAFRERKALALTLNDTKTAVNKLNQMTNIIVGVIVFALWLLILGIATTHFFVFLSSQLLVAVFVFGNTMKTIFEAIIFLFVMHPFDVGDRCEIEEVQLVVEEMNIMTTVFLRYDNLKIYYPNSVLATKPIMNFYRSPDMGEGIDFSIHVATPVEKLALMKERILRYIDNKKEHWYPGAMVVLRDVDDTNKLKVSIWLRHTLNFQDMGMRFVRRELVLQEMIKVLKDLDIEYRMLPLDVNVRNAPPLQSTRMPTTWNYS

SEQ ID NO: 1046 - protein, 142 aa, Brachypodium distachyon
MVVRRLHLPGQMATLLCINVPAGTHLIEVSSLGYFFSPVRVDISARNPGHIQAALTENRRVLNELVLEPLKEEQYYEIREPFNVMSLLKSPMGLMVGFMVLMVFVMPKMMENIDPEEIKQAQEQMRNSPVPSFSGLLARANS

SEQ ID NO: 1047 - protein, 258 aa, Brachypodium distachyon
MKIQCDSCGVAAATVVCCADEAALCGRCDVEVHAANRLASKHQRLPLDALGAGKLPRCDVCQEKAAFIFCVEDRALFCRDCDEPIHVPGTLSGNHQRYLATGIRVGFGGPVSACADADHGASHDADHHAPPMAPAAERPPAQAQQVPSPPQFLPQGWAVDELLQFSDYESSDKLHKESPLGFKELEWFTADMELFQDQTPKGGRTAIEVPEFLNSQAADDAAYYRPSRGAATAVVRQSKKARIEIPDDEDFFIVPDLG

SEQ ID NO: 1048 - protein, 358 aa, Brachypodium distachyon
PPSPITSAMATAAASLLVPPSSAACCAGPATSRALFPTSVPSLRAYPRLLLAFRRPAAAAVADPQGAGAAVLEEEEADDQTPVQFDDADDDYEDGYGGRGPAFTPPTRPRTGKAALPLKRDRTRSKRYLEIQKLRESKKEYGVRTALSLMKQVSNARFVESAEAHFRMNLDPKYNDQQLRATVNLPKGTGQTVKIAVLTQGEKIDEARAAGADIVGADDLIEQIKGGFMEFDKLIASPDMMPKVASLGKILGPRGLMPNPKAGTVSPNITQAIDEFKKGKVEFRVDKTGIAHIPFGKVNFPEEDLIANFMAVVRSIERNKPSGAKGIYWKTAYVCSSMGPSIKLNIKEMLDYGTESSD

SEQ ID NO: 1049 - protein, 493 aa, Brachypodium distachyon
QPPAAEETTREIQVVREAYRREPAAPAYVMPEEPPAMVELVGWYLYGFCSFFITHLLLPVLFPAIVTQVAFPASDFTPEAKYVVKGATCSVHEMSMYQRLTRHSIAIADSNLSPLGWSGLSWAIGILIAAPILTQVAHHLDRGQYQSLILIAATSFGSFFCLLTGFFKTVWVFLFYILFIASAIIVAEAVHTRNLGLMIRGLAAHDSGKHLVLRRRAAASQLSLYCTAIGGIGAALMAAFMYHMLRRTDQLTGLWVVSIFSGLIWFIGICHGLFTNRPSSSSPTTAFEPNFFTKLTYSMTIARYPQAIGSLVAVFLSSFATMCIFTSGTLYAIGGVCIKPVLVLVLWILYFLFPLISLPLLHPIQIIIRADAVRMQLLGFIIALFVSGAGFYFKNHRWRAAHIIVIALVQSTANGILYSFGRILLLDASPPGKEGAFAIWYAYVRCIGAMIGFAAASAGPGRAGGSFAAAFLGCFLGIIVLIFGNVSNIGALK

SEQ ID NO: 1050 - protein, 177 aa, Brachypodium distachyon
MESCPSVKNILLLDSEGKRVAVKYYTDDWPVLSSKLAFEKSVFVKTQKANSGAEAEIVMFDGHIVVYKFIQDLHFFVTGGDEENELILASVLQGFTDAVDLILRNNVEKRTALENLDLILLCLDEIVDGGIVLETEGSVIADKVSAHGAEGGTSIAEQTIVQALTTAREHFAKSLLM

SEQ ID NO: 1051 - protein, 158 aa, Brachypodium distachyon
LSLLVHPDKCKHPQAQEAFGALAKAQQLLLDPQERGYILDQVTAAKEELRAKRKKELKKDSASKIKSQVDEGKYEEQFERSDEFQKQLIIKVREILTDKEWRRRKMQMRISEEEGRLKKDEEETKEMWKRKREHEEKWEETRDKRVSSWRDFMKTGKK

SEQ ID NO: 1052 - protein, 229 aa, Brachypodium distachyon
HGENRTHARTEAQSSSPLLLATTTTMSPPRVLLLLAVVATAACFGAAVADQPGSGEGYTIAGRVKIDAASGKGFGLPAKTSNTKVILNGGQKVTFARPDGYFAFHNVPAGTHLIEVSSLGYFFSPVRVDISARNPGHIQAALTENRRVLNELVLEPLKEEQYYEIREPFNVMSLLKSPMGLMVGFMVLMVFVMPKMMENIDPEEIKQAQEQMRNSPVPSFSGLLARANS

SEQ ID NO: 1053 - protein, 448 aa, Brachypodium distachyon
NRSAENLYGYPASEVLGQDALMLLVDSRDLSVVNDMFRRISLGESWTGKFPVKNRAGDRFLAIGTNTPFYDEDGSLVGIICVSNDSHALEEILSGPSTSASSHLESSRPTCCDGSCSNNNRKNSLLNRSPFDPQHPLPSTIASKITNLATKVTNKVRSRVRMDENGVVREGGSGESQCSDRDTKEEPSSSGPSTPKGDASRGAFATEENSPGKSAKTNSDESEGKIGLHKILSSKAEALLIKKGISWPWKGRENDGPDGKNQVIWPSLHGEQEIDQNHQKISDSQGAECNQPNKNEVSGSWSSFNNNSSSSASSTGSTNSSVLYKVDHEADCLDYEILWEDLVIGEQVGQGSCGTVYHALWYGSDVGVKVFSRQEYSEEVIQAFRQEVSLMKKLRHPNILLFMGAVTSPHRLCIVTEFLPRGSLFRLLQRSTTKLDWRRRVHMALDVV

SEQ ID NO: 1054 - protein, 497 aa, Brachypodium distachyon
MARKMLKDGEVAVADGGGGESYEYDLFVIGAGSGGVRGSRTSAGFGAKVAICELPFHPISSEWQGGHGGTCVIRGCVPKKILVYGAAFRGEFEDAKNFGWEINGDINYNWKKLLENKTQEIVRLNGVYKRILGNSGVTMIEGAGSVVDAHTVEVTQPDGSKQRHTAKHILIATGSRAHLVDIPGKELAITSDEALSLEELPKRAVILGGGYIAVEFASIWKGLGAEVDLFYRKELPLRGFDDEMRTVVASNLEGRGIRLHPATNLTELSKTADGIKVVTDKGDELMADVVLFATGRTPNTNKLNLEAVGVEVDQIGAIKVDEFSHTSVPSIWAVGDVTNRINLTPVALMEATCFAKTVFGGQPVKPDYRDVPCAVFSIPPLSVVGLSEQEALEEAKNDILVYTSSFNPMKNSISKRQEKSIMKLVVDSETDRVLGAAMCGPDAAEIMQGIAVALKSGATKATFDSTVGIHPSAAEEFVTMRTLTRRVSPASKLKTNL

SEQ ID NO: 1055 - protein, 405 aa, Brachypodium distachyon
RDYLVRNSGEQVKISSIEAGTVALYFSASWCPPCRRFTPKLIEAYKELASQGKSFEVVFVSGDQDEEAFNAYFAKMPWLAVPFTDSEGRKSLDERFQVRGIPHLVILDAKTGKVCTEDGVEFVSEYGIDAYPFTPERINELKEQEKAAKDNQTIHSVLSTPTRDYLISNKGDKVPISDLEGKYVGLCFVVSGYGPVEEFTTVLAKIYGKLKEVGEKFEVVAVSMDNDEASFNESFQNMPWLAIPQGDKMCQKLVSYFELNDLPTLVLIGPDGKTLNSNIADIIEENGVESWEGFPFNAEKLEILAEKARAKAESQTLQSLLVTGDLDFVIGKDGAKVPVSQLVGKTVLLYFSAQWCGPCRAFLPTLVDVYNKIKEKNSDFEIVFISSDRDQSSFDDFFSGMPWLA

SEQ ID NO: 1056 - protein, 178 aa, Brachypodium distachyon
SLFRLLQKNTGKLDPRRRVNMAIDIARGMNYLHNSIPTVVHRDLKSSNLLVDKNWTVKVADFGLSRLKLETFLTTKTGKGTPQWMAPEVLRSEPSNEKSDVYSYGVVLWELITQKVPWDTLNTMQVIGAVGFMDHRLEIPSDADPQWSSMIESCWVSDPQRRPSFRELLERLQVLQKQ

SEQ ID NO: 1057 - protein, 361 aa, Brachypodium distachyon
MAAASTTDGGVGAILTAGERDYLVRNSGEQVKISSIEAGTVALYFSASWCPPCRRFTPKLIEAYKELASQGKSFEVVFVSGDQDEEAFNAYFAKMPWLAVPFTDSEGRKSLDERFQVRGIPHLVILDAKTGKVCTEDGVEFVSEYGIDAYPFTPERINELKEQEKAAKDNQTIHSVLSAPTRDYLISNKGDKVPISDLEGKYVGLCFVVSGYGPVEEFTTVLAKIYGKLKEVGKKFEVVAVSMDNDEASFNESFQNMPWLAIPQGDKMCQKLVSYFELNDLPTLVLIGPDGKTLNSNIADIIEENGVESWEGFPFNAEKLEILAEKARAKAESQTLQSLLVTGDLDFVIGKDGAKVCLTYA

SEQ ID NO: 1058 - protein, 441 aa, Brachypodium distachyon
LPVTCAILICLFALQHYGTHRVGFLFAPIVCIWLLCISTIGLYNIIRWNHHVYRALSPYYMYQFLKKTQTGGWMSLGGILLCVTGSEAMYADLGHFSQASIQIAFVSVVYPSLVLAYMGQAAYISQHHSFESSYHIGFYVSVPEKLRWPVLVIAILAAVVGSQAIITGTFSIIKQCSALSCFPGVKIVHTSSTVHGQIYIPEVNWILMILCLAVTIGFNNTKHLANAQGLAVITVMLVTTCLMSLVIVLCWNKSIFLALGFLLFFGTIEVLYFSASLVKFHEGAWVPITLSFIFMIVMSVWHYGTIKKYEFDVQNKVSVNWLLNLGPSLGIVRVRGIGLIHTELMSGIPAIFSHFVTNLPAFHQVLVFLCVKSVPVPHVEPEERFLVGRIGPKEYRLYRVIVRYGYRDVQQDDLEFEKDLIHSIAEFIRSGGSDQNGLMEG

SEQ ID NO: 1059 - protein, 361 aa, Brachypodium distachyon
FSGEPPAMGSSRCRGQRQLQLWFRFLALSSLLLLASGEVIFEERFEDGWETRWVKSDWKRSEGKAGTFKHTAGKYSGDPDDKGIQTTIDARHFAISAKIPEFSNKGRTLVVQYSIKFEQDIECGGGYIKLMSGYVNQKKYSGDTPYSLMFGPDICGTQTKKLHLILSYQGQNYPIKKDLQCETDRLTHVYTFILRPDASYSILVDNRERESGSMYTDWDILPPRKIKDVDAKKPKNWDDREYIEDPDEVKPEGYDSIPREIPDPKDKKPDTWDDDDDGIWKPRRIPNPAYKGQWKRKKIKNPNYKGKWKIPWIDNPEFEDDPDLYVLKPLKYIGIEVWQVKAGSVFDNILICDDPEYAKKV

SEQ ID NO: 1060 - protein, 161 aa, Brachypodium distachyon
MLSYSLLIDNREREFGSMYTDWDILPPRKIKQVNAKKPKDWDDREYIEDPDEVKPEGYDSIPKEIPDPNDKKPESWDDDEDGIWKPRMIPNPEYKGPWKHKKIKNPNYKGKWKAPWIDNPEFEDDPDLYVLKPLQYVGIEVWQVKAGSVFDNILICDDPEY

SEQ ID NO: 1061 - protein, 421 aa, Brassica napus
  misc_feature (168)..(168): Xaa can be any naturally occurring amino acid
  misc_feature (235)..(236): Xaa can be any naturally occurring amino acid
  misc_feature (242)..(242): Xaa can be any naturally occurring amino acid
  misc_feature (252)..(252): Xaa can be any naturally occurring amino acid
DICGDGGLFKKVIAEGEKWEKPKDLDEVYVKYEARLEDGTVVGRSDGAKFTVMDGHFCPAIAKAVKTMKRGEKVLLTVKPQYGFGETGRAASDCIQAAVPPNATLQMDLELVSWKTVVEVTDDKKVIKKILKEGEGYERPNEGAVVKLKLIGKLQDGTVFFKKGHGEXEEPFEFKTDEEQVIEGLEKAVMGMKKGEVALITISPEYAFGSSESKQELAVIPPDSTVCYEVELVSXXKEKESXDMNTQEKIEXAGKKKEEGNTLFKAGKYARASKRYERGVKFIEYDSSFDEEDKKKAKALKIACNLNNAACKLKLKDYKEAAKLSTKVLEMDGSNVKAMYRRAQAYMETADLDLAELDIKKVLEIDPDNKEVKMEYKKLKEKVREYNKKDAKFYSNMLAKMLEPHKEARKDAQAMSIDAKA

SEQ ID NO: 1062 - protein, 244 aa, Brassica napus
  misc_feature (221)..(221): Xaa can be any naturally occurring amino acid
  misc_feature (223)..(223): Xaa can be any naturally occurring amino acid
MIARILAGFMESPAVAAAGDSVLGTIKIAVMPIAKVFTMCFLGLLMASKYVNILPPSGRKLLNGLVFSLLLPCLIFSQLGQAVTLQKMLQWWFIPVNVVLGTISGSLIGLLVATIVRPPHPYFKFTIIQIGVGNIGNVPLVLLAALCRDTSNPFGDSEKCSIDGTAYISFGQWVGAIILYTYVYQMLAPPPEGFDGEHDNLPLKNLPLDSSAPEQSPCLLXIXLRTFHPFRFTSLYRPQNLEQE

SEQ ID NO: 1063 - protein, 242 aa, Brassica napus
  misc_feature (41)..(41): Xaa can be any naturally occurring amino acid
KVDDDAILKSFLAEVGEVERDNEVVRILSCFKLNPFEHLNXSFDSSTDDVKRQYRKISLMVHPDKCKHPQAQEAFGALAKAQQLLLNDQERDYILTQVQAAKEELKMKRKKQLKKDTASKIKSLVDEGKHEQIYEQSEEFQKELKLKVREILTDQEWRRRKMAMRISEEEGRLKKDEEEQKEIRKKKREHEEQWEGTRENRVSSWRDFMKAGKKAKKGETRPPKLKTEDPNKSYVQRPVKKG

SEQ ID NO: 1064 - protein, 151 aa, Brassica napus
MASLLDKAKDFVADKLAGVPKPEGSVTDVDLKDVNRDSVEYLAKVSVTNPYGHAIPICELNFTIHSAGREIGKGKIPDPGSLKAKDMTVLDVPIVVSYSILFNLARDVGADWDIDYLLEIGLSIDLPVLGDFTIPVTSKGEIKLPTFKDYF

SEQ ID NO: 1065 - protein, 233 aa, Brassica napus
METEKKKNSQELGLKHLGFVRVAAIHVLVSLSSLYDYAKQNSGPLKPAVGKVEGAVTTVVTPVYNKLKDVPDTLLLFLDHKVGEASDKFDKHAPPVAKKVVSRANVLIHKTTEKAQRFVKEARTGGPKAAFNYAATEYKCFLVTNSVRVWAKLNRFKPIHAVGNKAFPVAAHVSGIYNDLVTDMTQMGYPVVGYLPLVPVDDIVKAYEKEEGAAQKKGDVTDGNDSSSDSDTD

SEQ ID NO: 1066 - protein, 204 aa, Brassica napus
MASNQQSYKAGETRGKTQEKTGQAMGAMRDKAEESKNKTSQAAQTAQQKAHETAQSAKDKTSQTAQKTQQKADETTQSAKGKTSQAAQTAQDKARETKDKTGSYMSETGEAIKHKAQDAAQYTKETAQGAAQYTKETAEAGKDKTGGFLSQTGEHVKQMAMGAADAVKHTFGMATEEDDKEHFPGTTTGTTRTTDTTHQTYQRK

SEQ ID NO: 1067 - protein, 159 aa, Brassica napus
MQSMKETASNIAASAKSGMDKTKATLEEKAEKMTTRDPVQKQMATQKKEAKINQAEMQKREVREHNAAMKEAAGGGTGTGLGLGSATHSTTGHVGHGTGTHQMSDLPGHGTGQATGHVVERTTLTEPIGTNTGTGRTAAHNAHVGGGTTGYGTSGGYTG

SEQ ID NO: 1068 - protein, 300 aa, Brassica napus
MGVREKDPLAQLSLPPGFRFYPTDEELLVQYLCRKVAGYHFSLQIIGDIDLYKFDPWDLPSKALFGEKEWYFFSPRDRKYPNGSRPNRVAGSGYWKATGTDKIIMSDGHRVGIKKALVFYAGKAPKGTKTNWIMHEYRLIEHSRSHGSSKLDDWVLCRIYKKTSGSQRQAVASPVQACLEDQSTNMSSSPSSSSQLDDVLDSFPEMKDRSFDLPRMNSLRTILNGNFEWASLAGLNPMPELAPMTYGLSNYGGYHAFQSAESGCRSSQVDQEQNSTELTQSLGYSSSGFGLSGQMYEFRQ

SEQ ID NO: 1069 - protein, 315 aa, Brassica napus
  misc_feature (239)..(239): Xaa can be any naturally occurring amino acid
  misc_feature (275)..(275): Xaa can be any naturally occurring amino acid
MLRNLIWATSKHDVYFMKNYSLMHWSSLLQRSKEVLNVAKPIVPTMKHPGSLSQSISRVQISTMAVKDDLIVAGGFQGELICKRVNEPGVAFCTVLTSVENDITNSVDIYNTPSGSLRVITANNDCTVRVLDATNFAFLNSFTFDWSVNNVTASPDGKLVAVLGDSPECLLAEAGSGKVIHALEGHLDYSFSSAWHPNGQILATGNQDTTCRLWDVRNLSKSLKVLKGNMGAIRALRFXSDGRFLAMAEPADFVHVFDTEAGYSQCQEIDMFGEXAGISFSPDTEALFVGVADRTYGSLLEFSRKRNHLYLDSIF

SEQ ID NO: 1070 - protein, 267 aa, Brassica napus
MGVREMDPLAQLSLPPGFRFYPTDEELLVQYLCRKVAGYHFSLQVIGDIDLYKFDPWDLPSKALFGEKEWYFFSPRDRKYPNGSRPNRVAGSGYWKATGTDKIITSDGHRVGIKKALVFYAGKAPKGTKTNWIMHEYRLVEHSRSHGSSKLDDWVLCRIYKKTSGSQRQAVAPVQPCREEHSTNGSSSSSSSHHDDVLDSFPEMNDRSFNLPRVNSLRTLLNGNFDWASLAGLNPIPELAPTSNGYGGYDAFRAAEGEAESGLRNLQ

SEQ ID NO: 1071 - protein, 234 aa, Brassica napus
METEKNSKELGLNHLGFVRVAAIHVLVSLSNLYDYAKQNSGPLKPAVGKVEGAVTTVVTPVFNKFKDVPDTLLLFLDHKVGEVSNKFDKHAPPLAKQVVSQAHVLIQATTEKAQSFVKEARTGGPKAAFNYAATEYKYLVVTNSVKVWAKLNQYKPIHAVGNKALPLAANLSGMYNDLVTNMTKMGYPVVGYLPLVPVDDIVKAYEKEQDAAQKKGDTTTATDGNKSSSDSDTD

SEQ ID NO: 1072 - protein, 238 aa, Brassica napus
LLKRDRTRSKRFLEIQKLRETKKEYDVKTAISLLKQTANTRFVESVEAHFRLNIDPKYNDQQLRATVSLPKGTGQTVKVAVLAQGEKVDEAKNAGADIVGSDDLIEQIKGGFMEFDKLIASPDMMVKVAGLGKILGPRGLMPNPKAGTVTANIPQAIEEFKKGKVEFRADKTGIVHIPFGKVNFTEEDLLVNFLAAVKSVETNKPKGAKGVYWKSAHICSSMGPSIKLNIREMIDFKP

SEQ ID NO: 1073 - protein, 232 aa, Brassica napus
METEKKNSKELGLKHLGFVRVAAIHVLVSLSSLYDYAKQNSGPLKPAVGKVEGAVTTVVTPVYNKLKDVPDTLLLFLDHKVGEVSYKFDKHAPPVAKKVVSQASVLIQKTTEKAQRFVKEARTGGPKAAFNYAGAEYKCFLVTNSVRVWAKLNRFKPIHAVGNKAFPVAAHLSGIYNDLVTDMTQMGYPVVGYLPLVPVDDIVKAYEKEEGGAQKKGDAADGNKSSSDSDTD

SEQ ID NO: 1074 - protein, 417 aa, Brassica napus
  misc_feature (153)..(153): Xaa can be any naturally occurring amino acid
MDIESRSYQNTVKKESWRTVLTLAYQSLGVVYGDLSISPLYVFKSTFAEDIEHSDSNEEIFGVLSFIVWTITLVPLFKYVFIVLRADDNGEGGTFALYSLLCRHARVNSLPSCQLADEQLAEYKTESPSEEEMGPPSGFAARLKSTLEKRRVXQKVLLVLALIGTCMVIGDGVLTPAISVFSAVSGVELSTAKEHHKYIEVPAACVILIGLFALQHYGTHRVGFLFAPVILLWLMCISAIGVYNIFHWNPHVYQALSPYYMYKFLKKTQSKGWMSLGGILLCITGSEAMFADLGHFSQLSIKIAFTSLVYPSLILAYMGQAAYLSQHHVIDTSYNIGFYVSVPEKLRWPVLVIAILAAVVGSQAIITGTFSIIKQCSALGCFPKVKIVHTSSKIHGQIYIPEINWLLMVLCLAVTIG

SEQ ID NO: 1075 - protein, 270 aa, Brassica napus
PHSLSWWIIVLAQVLYIKVSPRCRRTWTGFSWKAFDGLWDFFRLSAASAVMLCLESWYAQILVLLAGLLKNPELALDSLAICMSISAISFMVSVGFNAAASVRVSNELGAGNPRSAAFSTAVTTGVSFLLSLFEAVLILSWRNVISYLFTDSPAVAEAVAELTPYLAITIVLNGVQPVLSGVAVGCGWQAFVAYVNIGCYYIVGIPIGYVLGFTYDMGAKGIWTGMIAGTLMQTIILLIVTFRTDWDKEVEKASRRLDQWEDTQAPLLKQ

SEQ ID NO: 1076 - protein, 319 aa, Brassica napus
MATIRVPDEVPSPAQDSETLNKAFRGWGTDEKAIIRVLGKRNESQRKRIRESYKEIYGKDLIDDLSSELSGDFKKAVILWTKDPAERDARLANKVLNDKKKTIEKLKILVEISCTSSPNHLIAVRKAYCSLYDSSLEQDIASSVPFPLAKLLVTLATSFRYDKEKVDKEVATIEAGMLHEAISKKQLDHDHVLYIIGTRSIYQLRATFVAYKQSYGNTLDKDVDGCPGDADLRSLLQMVILCIEFPEKHFAKVVRDSIEGFGTDEDSLTRAIVMRAEIDLMKVRGEYFNMYNASMDNAIIGDVSGDYKDFLMTLLGSKI

SEQ ID NO: 1077 - protein, 355 aa, Brassica napus
MNGGHLPTAASDDLKSPLLPVVHNDEPFEKQTLGHHLRTIFTPKNCYIALGPLLCAVVCLCARLGGEDTTTAKNMLGVLVWMFAWWLTEAVPMPITSLSPLFLFPLFGITTADHVASSYMDDVISLVLGSFILALAVEHYNIHRRLALNITMVFCVEPLNAPLLLLGICATTAFVSMWMHNVAATVMMMPVATGILQRLPSSPSSSSEMVPPAVGKFCRAVVLGVIYSAVVGGMSTLTGTGVNLILVGMWKSYFPEADPISFSQWFFFGFPLALSLFVVLWGILCVLYCPKGTGKVLSPYLHKSHLRTELEMLGPMSFAEKMVLSVFGGLVVLWMTRNITDDIPGWGCIFNGRAG

SEQ ID NO: 1078 - protein, 550 aa, Brassica napus
MDEDFEMPPVGGMNGDDEMDFGDDASFLKVGEEKEIQQGLKKKLLKEGEGFETPENGDEVEVHYTGTLLDGTKFDSSRDRGTPFKFTLGQGQVIKGWDIGIKTMKKGENAVFTIPSELAYGESGSPPTIPANATLQFDVELLSWSSVKDICKDGGVFKKIVAAGEKWEMPKDLDEVLVKYVAKLEDGTVVGKSDGVEFTVKDGYFCPALAKAVKTMKKAEKVLLTVKPQYGFGEKGKPASGGEAAVPPNATLEIELELVSWKTVSEVTDDNKVIKKILKEGEGYERPNEGAVVKVKLIGKLGDGTVFLKKGHGEGEEPFEFKTDEEQVIDGLDKALLKMKKGEVALVTIDPVYAFGSTESKQELAVVPPNSTVYYEVDLVSFDKERESWDMNTEEKIEAAGKKKEEGNAKFKAGKYALASKRYEKAVKYIEYDSSFSEDEKKQAKALKVACNLNDAACKLKLKEYRQAEKLCTKVLELESTNVKALYRRAQAYMELADLDLAEFDVKKALEVDPDNREVKVEQRRLKEKMKEFNKKEAKFYGNMFAKLSK

SEQ ID NO: 1079 - protein, 501 aa, Brassica napus
MNSESLENLHRPLIESSKSFIDYRLETVLTDRELPYLRRIYLAMMIEMKFLFHLAAPAIFVYVINNGMSILTRIFAGHVGSSQLAAASLGNSGFNMFTYGLLLGMGSAVETLCGQAHGAHRYEMLGVYLQRSTVVLIITCLPMSLLFIFSKPLLNTLGEPEQVASMASVFVYGMIPVIFAYAVNFPIQKFLQAQSIVTPSAYISAATLVIHLVLSWIAVYRLGFGLLALSLIHSLSWWIIVAAQIVYIKMSPKCRRTWEGFSWKAFEGLWDFFRLSAASAVMLCLESWYSQILVLLAGLLKNPELALDSLAICMSISAISFMVSVGFNAAASVRVSNELGAGNPRAAAFSTFVTTGVSLLLAVFEAVVVMSWRNVISYAFTDSPEVAEAVADLSPFLAITIVLNGVQPVLSGVAVGCGWQAFVAYVNIGCYYVVGIPIGFVLGFTYDMGAKGIWTGMIGGTLMQTIILVIVTFRTDWDKEVEKASSRLDQWEESREPLLKQ

SEQ ID NO: 1080 - protein, 262 aa, Brassica napus
MNSESLENLHRSFIESSKSFIDYRLETVLTDRELPYLRRIYLALMIEMKFLFYLAAPAILVYVINNGMSILTRIFAGHVGSTELAAASLGNSGFNLFTYGLLLGMGSAVETLCGQAHGAHRYDMLGVYLQRSTVVLILTCLPMSLLFIFSKPLLSTLGEPEQVATMASVFVYGMLPVIFAYAVNFPIQKFLQAQSIVTPSAYISAAALVIHLVLSWVAVYRLGFGLLALSLIHSFSWWIIVAAQIVYIKMSPRCRRSWEGFS

SEQ ID NO: 1081 - protein, 151 aa, Brassica napus
MASLLDKAKDFVADKLAGVPKPEGSVTDVDLKDVNRDSVEYLAKVSVTNPYGHAIPICEINFTIHSGGREIGKGKIPDPGSLKAKDMTVLDVPIVVPYSILFNLARDVGADWDIDYLLEIGLTIDLPVVGDFTIPVTSKGEIKLPTFKDYF

SEQ ID NO: 1082 - protein, 330 aa, Brassica napus
MDEDFEMPPVGGMNGDDEMDFGDDASFLKVGEEKEIQQGLKKKLLKEGEGFETPENGDEVEVHYTGTLLDGTKFDSSRDRGTPFKFTLGQGQVIKGWDIGIKTMKKGENAVFTIPSELAYGESGSPPTIPANATLQFDVELLSWSSVKDICKDGGVFKKIVAAGEKWETPKDLDEVLVKYVAKLEDGTVVGKSDGVEFTVKDGYFCPALAKAVKTMKKAEKVLLTVKPQYGFGEKGKPASAGEAAVPPNATLEIELELVSWKTVSEVTDDNKVIKKILKEGEGYERPNEGAVVKVKLIGKLGDGTVFLKKGHGEGEEPFEFKTDEEQVID

SEQ ID NO: 1083 - protein, 196 aa, Brassica napus
MASNQQSYKAGETRGKTQEKTGQAMGAMRDKAEEGKNKTSQAAQTAQQKAHETAQSAKDKTSQTAQTTQSAKDKTSQAAQTTQDKARETKDKTGSYMSEAGEAIKNKAQDAAQYTKETAKGAAQYTKETAEADRDKTGGFLSQTGEHVKQIAMGAADAVKHTFGMATEEDDRENFPGTTTGTTRTTDTTHQTYQGK

SEQ ID NO: 1084 - protein, 187 aa, Brassica napus
KISLMVHPDKCKHPQAQEAFGALAKAQQLLLNDQERDYILTQVHAAKQELKMKRKKQLKKDTASKIKSLVDEGKHEQLYEQSEEFQKELKLKVREILTDQEWRRRKMAMRISEEEGRLKKDEEEQKEIRKKKREHEEQWEGTRENRVSSWRDFMKAGKKAKKGETRPPKLKTEDPNKSYVQRPVKKG

SEQ ID NO: 1085 - protein, 442 aa, Brassica napus
  misc_feature (30)..(30): Xaa can be any naturally occurring amino acid
  misc_feature (39)..(39): Xaa can be any naturally occurring amino acid
  misc_feature (58)..(58): Xaa can be any naturally occurring amino acid
  misc_feature (194)..(194): Xaa can be any naturally occurring amino acid
MGRKSQRKNVPMDLFDSDDDTSSISSSSTXRSERPGMDXVQVHKDLMLDQSLDALYEXRTSTREQALASIVDAFNSDLQHEFVEKKFATLLHQCLHCTKKGSSKETSLASHVIGLLALTVGLGDQAQEILEESVTPLSQALKSGREVLKITSILECLAVITFVGGTNPEQTETSMQIIWQMIHPKLGSNVVATXPSPAVITTVVSSWAFLLTTVDRWTLSPKLWQEIVTYLSSLLEKDDRSVRIAAGEALALIFESGTLEKFAAEAKESANNGSVKEGSVSQEALIHMHGLKSKVVNQVRDLSVEAGGKGSAKKDLNTQRNLFKDLVEFLEDGYAPETSTKVGGDYLQTSTWYQMIQLNFLKHFLGGGFIKHMQENEFLHDVFNFTPKKVGGRGSGMSSEEKRLFKSPNSALNKARTQFLNKQRMLAKNMNDGHYAATVENE

SEQ ID NO: 1086 - protein, 298 aa, Brassica napus
FPKRAIVLGGGYIAVEFASIWRGMGATVDLFFRKELPLRGFDDEMRALVARNLEGRGINLHPQTSLAELIKTDDGIKVISSHGEEFVADVVLFATGRIPNTKRLNLEAVGVELDQAGAVKVDEYSRTNIPSIWAVGDATNRINLTPVALMEATCFANTVFGGKPTKADYTNVACAVFCIPPLAVVGLSEEEAVEKATGDILVFTSGFNPMKNTISGRQEKTLMKLIVDEKTDKVIGASMCGPDAAEIMQGIAIALKCGATKAQFDSTVGIHPSSAEEFVTMRTVTRCIAYKAKPQTSL

SEQ ID NO: 1087 - protein, 583 aa, Ricinus communis
MEEDFDIPAGDEMMMNDDVDLGDQSPILKVGEEKEIGKQGLKKKLVKEGEGWDTPDNGDEVEVHYTGTLLDGTQFDSSRDRGTPFKFTLGQGQVIKGWDQGIKTMKKGENAIFTIPPELAYGASGSPPTIPPNATLQFDVELLSWTSVKDICKDGGIFKKILVEGEKWENPKDLDEVLVNFEAQLEDGTVVAKSDGVEFAVKEGHFCPALAKAVKTMKKKEKVLLTVKPQYGFGEKGKPASNGEGAVPPNATLQITLELVSWKTVSEVTDDKKVMKKILKEGEGYERPNDGSLVKLKLIGKLQDGTVFLKKGHDNEEELFEFTTDEEQVIEGLDRAVLAMKKGEVALVTIAPEYAFGASESKQELAVIPPNSTVYYEVELVSFVKEKESWDMNTQEKIEAAGKKKEEGNILFKAGKYARASKRYEKAVKHIEYDSSFSEEEKKQAKALKVACNLNNAACKLRLKEYKEAEKLCTKVLDLESRNVKALYRRAQAYIQLADLDLAEFDIKKALEIEPDNRDVKLEYRTLKDKMRELNKKEAKFYGNMFAKMNKLGPLDSNVSILACFSWNYWWVVYASCTVILIC

SEQ ID NO: 1088 - protein, 271 aa, Ricinus communis
MSFQDLEAGRPFAGSKINGKKDATQGVVSGIFQITTSVSTFQRLVNTLGTPKDTPELREKLHKTRLHIGQLVKDTSAKLKQASETDHHAGVSQSKKIADAKLAKDFQAVLKEFQKAQRLAAERETAYTPFVPQAVLPSSYTASEIDINSDKSPEQRALLVESRRQEVLLLDNEIAFNEAIIDEREQGIQEIHQQIGEVNEIFKDLAVLVHEQGAMIDDIGSHIENAQAATAQGKTHLVKAAKTQRSNSSLSCLLLVIFGIVLLIVIVVLAA

SEQ ID NO: 1089 - protein, 574 aa, Ricinus communis
MEEDFDIPAGDEMMMNDDVDLGDQSPILKVGEEKEIGKQGLKKKLVKEGEGWDTPDNGDEVEVHYTGTLLDGTQFDSSRDRGTPFKFTLGQGQVIKGWDQGIKTMKKGENAIFTIPPELAYGASGSPPTIPPNATLQFDVELLSWTSVKDICKDGGIFKKILVEGEKWENPKDLDEVLVNFEAQLEDGTVVAKSDGVEFAVKEGHFCPALAKAVKTMKKKEKVLLTVKPQYGFGEKGKPASNGEGAVPPNATLQITLELVSWKTVSEVTDDKKVMKKILKEGEGYERPNDGSLVKLKLIGKLQDGTVFLKKGHDNEEELFEFTTDEEQVIEGLDRAVLAMKKGEVALVTIAPEYAFGASESKQELAVIPPNSTVYYEVELVSFVKEKESWDMNTQEKIEAAGKKKEEGNILFKAGKYARASKRYEKAVKHIEYDSSFSEEEKKQAKALKVACNLNNAACKLRLKEYKEAEKLCTKVLDLESRNVKALYRRAQAYIQLADLDLAEFDIKKALEIEPDNRDVKLEYRTLKDKMRELNKKEAKFYGNMFAKMNKLGPLDSNNSKSNEAGQMSIDSKA

SEQ ID NO: 1090 - protein, 250 aa, Ricinus communis
MGDRTSPTTTDDDLLLKSFFAEVSEVERDNEVARILSCFKLNPFEYLNLPFDASLEDVKKQYRKLSLLVHPDKCKHPQAKDAFGALAKAQQLLLDQQERDYLLSQVVAAKEELLAKRKKQLKKDTASKIKSLVDEGKYDQLYERSEEFQRELKLKVRELLTEQEWRRRKMQMRISEEEGRLKKDEEEQKEIWKRKREHEEQWEGTREQRVSSWRDFMKTGKKGKKGEIRPPKLKTEDPNKSYVQRPVKRA

SEQ ID NO: 1091 - protein, 496 aa, Ricinus communis
MARKMLIDGELNQSNEQEAQFDFDLFVIGAGSGGVRASRFSANYGAKVGICELPFNPISSDSDGGVGGTCVLRGCVPKKILVYGASFGGDIEDARNFGWDINEKVEFNWKKLLQKKTDEITRLNGIYKRLLSNSGVKLFEGEGKIVGPNEVELTQLDGTKLSYSAKHILIATGSRAQRPAIPGHELAITSDEALSLEDMPKRAVVLGGGYIAVEFASIWRGMGATVDLVFRKELPLRGFDDEMRAVVARNLEGRGINLHPRTNLTQLTKTENGIKVLTDHGEEFMADVVLFATGRAPVTKRLNLEAVGVELDHAGAIKVDEYSRTNIPSIWAIGDVTNRMNLTPVALMEGTCFAKTVFGGESCKPDYTNVPCAVFCIPPMSVVGLSEEQAIEQANGDILVFTSSFNPMKNTISARQEKTVMKLVVDAETDKVLGVSMCGPDAPEVVQGMAVALKCGATKAQFDSTVGIHPSAAEEFVTMRSLTRRVNAGNKPKTNL

SEQ ID NO: 1092 - protein, 796 aa, Ricinus communis
MESPPAAEELLKKIQELEAGQAHLKEQMSKFKLTSDPVSDSQLHHHHHHHHHHHRQQQQQQQQQRSHSISPQRTGTRRSGGGAGAGGFEVVAAWKKGSTSFRHSSPLQRESRSSSADKINAAVKEEGGNKCGPSAVKFTDKQYLNILQSMGQSVHIFYLSGRIIYWNRTAENLYGYSSAEALGQDAIELLVDPRDFAVANNIVHRVAMGERWTGQFPVKNKMGERFTAVATNTPFYDDDGTLIGIICVSGDVRPFQETRVALIGPKNSEADSSFSRPRSTVTTKLGLDSQQPLQAVIASKITNLASRVSNKVKSKIRTGDNIMDREGGSGDSHQSDHGFSDAALSDHREDANSSGASTPRGDIHPSQFGTFSHVDEKSPMKAIRDSGYESEGKPGIHKIITSKAEAWIGKKGLSWPWKGIEREGPDTKTSRFVWPWLQNDQESELLHQRSPPAGAKPESQLNESNRPTNNEASGSWSSSVNVNSTSSASSCGSTSSSAINKVDMDIDCLDYEILWEDLTIGEQIGQGSCGTVYHALWYGSDVAVKVFSKQEYSDDVILAFRQEVSLMKRLRHPNVLLFMGAVTSPQRLCIITEFLPRGSLFRLLQRNTTKLDWRRRIHMALDIVRGMNYLHHCNPPIIHRDLKSSNLLVDKNWTVKVGDFGLSRLKHETYLTTKTGKGTPQWMAPEVLRNEPSDEKSDVYSFGVILWELATEKIPWDNLNSMQVIGAVGFMNQRLEIPKDVDPLWASIIESCWHSDPQCRPTFQELLEKLRDLQRQYAIQFQAARSAAGDNTQKEL

SEQ ID NO: 1093 - protein, 543 aa, Ricinus communis
MGCFTVLKSKKKKPEPSVSIKRVSPKEQTPTTLPEPQIPTRSLQSAPPSFRTRVKPVQPDNRLINNRARVKSAPESLDSAEQDDLAAIEYDEHEELKSRVSLARDHLSPQPLPLPAAALKPAGSLKFTNGSGPLYASGPLPLPPGVTQSGTLRNFSYDEIISACRNFSSDRCVSEGLSSIIYRASFGDDTSSSKKFEATVTRLHSSPQGFKEFINEVNTLASLRHPNLCKLLGYHARDGSEQRMLIYERLYHGSLDRLLYGRLDGPPIDWNTRMKIALCAAQGLTFLHEEGPFQAMYNEFSTGNIQIDKDFSAKLSGYGCVGHIPETEISNSSVAVANLSVETLERGLLTPKSNVWSFGIVLLELLTGRKNLDNRHPKEERNLVRWSRPFLDDDCRLSLIMDPQLKGRFPLKAARTVADIALRCLKKDPLERPTMRAIVENLRVIQDMKSSTRFPLQEPAAVAGKQMSRSPSLNGIITPAPRLSFSPSPPSRARPSLSPTRPPALPISLPPRACSTLSLDELEQQESRKSSSSAVRRPSVEGF

SEQ ID NO: 1094 - protein, 535 aa, Ricinus communis
MNTSDPISDDPKTPFLPVSDPIIQRQASSHSSSVASQLLTPGNFYILLGPLLCTIICLSVKLDAPATSRNMLGVLAWMFSWWVTEAVPMPITSMTPLFLFPLFGIASADHVAKSFMDDVISLVLGSFILALAVEHYNIHRRLALNITQLFCGEPLNPPLLLLGICATTAFVSMWMHNVAAAVMMMPVATGILQRLPPNQTQNNELRNFSKAVVLGVIYSAAVGGMSTLTGTGVNLILVGMWKSYFPEADPISFNTWFFFGFPLALIIFFALWAILCLLYCSRRSSRELSAYLDKAHLKRELELLGPMAFAEKMVLAIFGMLIVLWMTRSITDDTPGWGALFKGRAGDGTASVLMATFLFIIPNKKQKGEKLMDWNKCKKLPWNIVLLLGAGFAIADGVRTSGLADVLSKALAFLEGAPYWAIAPAVCLISATITEFTSNNSTTTLVVPLLIQIAKTMRVHPLLLMVPGAIGAQFAFLLPTGTPSNIVGFTTGHIEIKDMIKTGVPLKIAGIAALSFIMPTLGAYVFGTNGGVQKM

SEQ ID NO: 1095 - protein, 230 aa, Ricinus communis
MTTAARPTWAPAKGGNEQGGTRIFGPSQKYSSRDLAAHTNLKPRREGQDTQDELQKRNLREELEERERRHFSSKDKSYNDDRDRRKSNQLLLEGAKRDTEDRIIPRSVDADDSDVEVNNDDESDDEDDDDDEDDTEALMAELERIKKERAEEKLRQEQQEAAEELKVKEEQLLRGNPLLNNPTSFNVKRRWDDDVVFKNQARGETKAPKRFINDTIRNDFHRKFLQKYMK

SEQ ID NO: 1096 - protein, 625 aa, Ricinus communis
MREKLGFLGFVLLMLCGSCLGRFVVEKNSLRVTSPDSVKGIHECAIGNFGVPQYGGTLVGTVVYPKANQKACKGFDEVDISFKSKPGGLPTFLLADRGDCYFTLKAWNAQNGGAAAILVADDKLEPLITMDTPEEENADADYLQKINIPSALITKSLGDSIKKALSGGEMVNINLDWTEALPHPDERVEYEFWTNSNDECGPKCDSQMDFVKNFKGAAQILEQKGYTQFTPHYITWYCPEAFILSKQCKSQCINHGRYCAPDPEQDFSKGYDGKDVVVQNLRQACFFKVANESGKPWLWWDYVTDFAIRCPMKDKKYTKECADQVIQSLGVDIRKIDKCIGDTEADVDNPVLKAEQDAQIGKGSRGDVTILPTLVVNNRQYRGKLDKGAVLKAICAGFQETTEPAICLSEDVETNECLENNGGCWQDKAGNLTACKDTFRGRVCECPVVRGVKFVGDGYTHCEASGSLRCEINNGGCWKKTQDGRTFSACVEDHSQGCKCPPGFKGDGVNSCEDVDECKEKSACQCPECKCKNTWGGYDCSCSSGLLYIQEHDTCISKAANTEVGWSFIWIIILALAAAGVAGYATYKYRIRRYMDSEIRAIMAQYMPLDNQGEIPVHHAARGDI

SEQ ID NO: 1097 - protein, 762 aa, Ricinus communis
RDSWKTVLTLAYQSLGVVYGDLSTSPLYVYKSAFAEDIQHSETNEEIYGVLSFVFWTLTLIPLVKYVFIVLRADDNGEGGTFALYSLLCRHARVSSIPNCQLADEELSEYKKDGSVFNDKSGIGSSLKSTLEKCRILQRLLLVLALIGTCMVIGDGVLTPAISVFSAVSGLELSMSKEQHQYVELPVACAILVFLFSLQHYGTHRVGFLFAPVVITWLLCISAIGVYNILHWNPHVYQALSPYYMYKFLKKTQRGGWMSLGGILLCITGSEAMFADLGHFSQLSIKIAFTFVVYPSLILAYMGQAAYLSKHHIIESDYRIGFYVSVPEKIRWPVLAIAILAAVVGSQAIITGTFSIIKQCSSLGCFPKVKIVHTSSKMHGQIYIPEINWTLMLLCLAVTVGFRNTKHMGNASGLAVITVMLVTTCLMSLVMVLCWHKNVLLAICFIFFFGSIEALYFSASLIKFLEGAWVPIALSFIFLVVMYVWHYGTLKKYEADVQNKVSINWLLSLGPSLGIVRVRGIGLIHTELVSGIPAIFSHFVTNLPAFHQVVVFLCIKSVPVPHVRPEERFLVGRVGPKEYRLYRCIARYGYRDVHKDDMEFEKDLVCSIAEFIRSEKPESDIGIEDVGEYEKMTVIGTLSSSFEGVKMREDDTDSSDMVGTSEVKEIQAPQRSKKRVRFVVPESPQMDRDVRDELQELMEAREAGMAFILGHSYVRAKRGSSWMKKVVINYGYDFLRKNSRGPRYALSIPHASTLEVGMVYYV

SEQ ID NO: 1098 - protein, 412 aa, Ricinus communis
MERFLSAVVSMDNQVAGQSLIGTIRIAVLPIAKVFTMCFLGFLMASKYVNILPANGRKLLNGLVFSLLLPCLIFSQLGQAVTLRKMMEWWFIPVNVVLGSISGSIIGLVVAYVVRPPYPFFKLTIVQIGIGNIGNVPLVLIAALCRDTSNPFGDSETCSTDGTAYISFGQWVGAIILYTYVFHMLAPPPEGTFDIEDGNLPIKDTPKDGTPEQVPLLTHEDLPTDSDASKQGKFKEILMYLYEKLKLKQILQPPIIASILAMFLGAVPFFKRLIFTTDAPLYFFTDSCNILGEAMIPCILLALGGNLVDGPGTSKLGLRTTAAIIFARLLLVPPAGLGIVMLADKLGFLPAGDKMFRFVLLLQHSMPTSVLAGAVANLRGCGREAAAVLFWVHIFAVFSMAGWIVLYLNILF

SEQ ID NO: 1099 - protein, 469 aa, Centaurea maculosa
  misc_feature (76)..(76): Xaa can be any naturally occurring amino acid
  misc_feature (145)..(145): Xaa can be any naturally occurring amino acid
  misc_feature (185)..(186): Xaa can be any naturally occurring amino acid
  misc_feature (192)..(193): Xaa can be any naturally occurring amino acid
  misc_feature (205)..(205): Xaa can be any naturally occurring amino acid
  misc_feature (231)..(231): Xaa can be any naturally occurring amino acid
  misc_feature (258)..(258): Xaa can be any naturally occurring amino acid
MSLGDSIKKALAKGDMVNIKLDWTEALPHPDERVEYEFWTNSNDECGSKCDSQIEFVKNFKGAAQILERKGYTQFXPHYITWYCPEAFTLSKQCKSQCINHGRYCAPDPEQDFSKGYDGKDVVVQNLRQACFYKVANETGKPWLXWDYVTDFSIRCPMKDNKYTKECADEVIKSLGVDLKKIDEXXGDPEAXXDNPVLKAEQEAXIGKGTRGDVTILPTLVINNRQYRGKXGKQAVLKAICSGFEETTEPALCLSDEXETNECLDNNGGCWMDKAANITACRDTFRGRVCECPVVQGVKFVGDGYKHCEASAALRCEVNNGGCWKGTKLGRTYSACIDDHTKGCKCPPGFKGDGVNSCEDIDECKEKTACQCSQCKCKNTWGSYECSCAGNLLYMREHDTCISKDGKSEVNWGFVWVIILGLAVAGAAGYAFYKYRIRTYMDSEIRAIMAQYMPLDNQAEVEVHGTHGN

SEQ ID NO: 1100 - protein, 279 aa, Centaurea maculosa
  misc_feature (165)..(165): Xaa can be any naturally occurring amino acid
  misc_feature (211)..(211): Xaa can be any naturally occurring amino acid
MSFQDIEAGRPLNSRRGGGGLNNNGMRKQDPTQAVASGIFQINTAVSTFQRLVNTLGTPKDTPELRDKLHKTRLHIGQLVKDTSEKLKQASETDHRADVSASKKITDAKLAKDFQAVLKEFQKAQRLSAERETAYTPFVPQAAYPSSDPANEMDASSGKSQEQRXLLVDNKRQEVLLLDNEIAFNEAIIEERDQGIQEIQNQIGEVNEIFXDLAVLVHEQGTMIDDIGSNIENSHAATAQAKSHLAKASKTQRSNSSMTCLLLVILGIVLLIVIIVLAV

SEQ ID NO: 1101 - protein, 263 aa, Centaurea maculosa
MVEEVRNKQVILKDFVNGFPKESDMLLDASSTISLKLPEPSNGLLVKNLYLSCDPYMRGRMSDIQGSYVPSFTPGSPITGYGVAKVLDSGHPNFKKGDLFWGFTGWEEYSIITAPESLFKIEHTDVPLSYYTGILGMPGMTAYAGFYEICAPKKGEYVFVSAASGAVGQLVGQFAKLSGCYVVGSAGTKEKVELLKNKFGFDEAFNYKEEQDLDAALKRYFPDGIDIYFENVGGKMLEAVLLNMRLNGRISVCGMISQPPPGT

SEQ ID NO: 1102 - protein, 569 aa, Centaurea maculosa
MDEDFDIPAAEEMNDEFMDDIEGPVSLKVGEEKEIGNQGLKKKLLKEGEGWDTPESGDEVEVHYTGTLLDGTQFDSSRDRGTPFKFTLGQGQVIKGWDQGIKTMKKGENALFTIPADLAYGESGSPPTIPPNATLQFDVQLLSWVSVKDICKDGGIFKKIVKEGEKWENPKDLDEVLVNYEVKLEDGTLITKADGVEFTVQDGHFCPAISAALKTMKKGEKVVLTVKPQYGFGEKGKPASGDQASVPPNATLQITLELVSWKVVSNVTDDKKVVKKILKEGEGYERPNEGAVVQVNLIGKLQDGTVFIKKGHDGVDPFDFKADEEQVIDGLDRAVMTMKKGEVALLTIEPEYAFGSAGSKQELAVVPPNATVTYEVELISFIKDKESWDMNTPEKIEAAGKKKEEGNAFFKAGKYLKAVKRYEKAAKFIEYDTNFEEEEKKQAKALKITCNLNNAACQLKLKDYKQAEKLCTKVLELESTNVKALYRRAQAYINVADLDLAELDIKKALEIDPNNKDVKLEYKVLKEKIKEYNKKDAKFYGNMFAKMTKSSTNKPATKDAEPMTIDSKA

SEQ ID NO: 1103 - protein, 432 aa, Centaurea maculosa
  misc_feature (20)..(20): Xaa can be any naturally occurring amino acid
MSNHGVGRSSSLSLIFGALXFVLLSICDFSYSEIIFEERFEDGWQSRWVKSDWKRSEGKAGNFKHTAGSWSGDPDDKGIQTTTDARHFAISAKIPEFNNKNRTLVLQYSIKIEQDIECGGGYIKLMSGYVNQKKFGGDTPYSVMFGPDLCGTQTKKLHVILSYQGQNYPIKKDLQCETDKLTHFYTFILRPDASYSILIDGRERDSGSMYTDWDILPPRKIKDVKAKKPADWEEREYIEDPDQVKPEGYDSIPREIPDPKAKQPDTWDEDEDGIWRPPKIPNPAYKGPWKPKKIKNPNYKGKWKIPWIDNPEFEDDPDLYVLKPIKYVGIEVWQVKAGSVYDNILICDDPEYAKDVIQEVFTNREIEKEALEEAEKAKKAREEEEAQRAREEGERRKRERGYDRRHRDKERYKDRYRKYNRRDYLDDYHDEL

SEQ ID NO: 1104 - protein, 496 aa, Centaurea maculosa
  misc_feature (299)..(299): Xaa can be any naturally occurring amino acid
MTSRKMLIDGDVGENTEDIQYDFDLFVIGAGSGGVRASRFSAQYGAKVGICELPFHPVSSEVIGGVGGTCVIRGCVPKKILVYGATFGPEIQDSREYGWQVNEKIDFDWKKLLHKKTEEILRLNGIYKRLLSNAGVKLFEGEGRIVGPNEVEVIQLDGTKLSYTAKHILIATGSRAARVSIPGQELAITSDEALSLEELPKRVVVLGGGYIAVEFASIWRGMGSTVNLCFRKELPLRGFDDEMRALVARNLEGRGIILHPQTNLTELVKTEDGIKVTTDHGEELMADVVLFATGRLPNXKRLNLQSVGVEVDSAGAVKVDEFSRTNVPSIWAIGDVTNRMNLTPVALMEGTLFAKTVFGNEPSKPDYSNIPCAVFCIPPLSVVGLSEEEAIEKAQGDILVFTSTFNPMKNSISGRQEKTLMKLIVSAETDKVLGASMCGPDAAEIMQGIAIALKCGATKAQFDSTVGIHPSSAEEFVTMRSVTRRIAAAGKPKTNL

SEQ ID NO: 1105 - protein, 76 aa, Centaurea maculosa
  misc_feature (65)..(65): Xaa can be any naturally occurring amino acid
MATTEQPKVAATEEAKIDLFEDDDEFEEFEIDHEWDVKEEGKEVSQQWEDDWDDDDVNDDFSLQXRRELESNTEKK

SEQ ID NO: 1106 - protein, 126 aa, Centaurea maculosa
MDVSSKRGQEQHALLMESRQEVLLLDNEIAFNEAIIEEREQGIQDIQNQIGEVNEIFKDLAVLVHEQGAMIDDIGSNIENSHAATAQARVHLSKASKTQRANSSMTCLLLVIVGIVLLIVIIILAV

SEQ ID NO: 1107 - protein, 317 aa, Cichorium intybus
  misc_feature (261)..(261): Xaa can be any naturally occurring amino acid
  misc_feature (294)..(294): Xaa can be any naturally occurring amino acid
MDEDFDIPAADEMNEEFMDDIEAPVTLKVGEEKEIGNQGLKKKLLKEGEGWDAPESGDEVEVHYTGTLLDGTQFDSSRDRGTPFKFTLGQGQVIKGWDLGIKTMKKGENALFTIPADLAYGEAGSPPTIPPNSTLQFDVQLLSWVSVKDICKDGGIFKKIVKEGEKWENPKDLDEVIVNYEVQLEDGTVVAKADGVEFKVEDGHFCPALQKAVKTMKKGEKVILTVKPEYGFGEKGKPASGDGAPIPANATLKITLELLSXKIVTNITDDKKVIKKILKEGEGYERPNEGAVVXVNLIGKLQDGTVFIKRGHDDTDP

SEQ ID NO: 1108 - protein, 495 aa, Cichorium intybus
MSRKMLIDGDVGNDIDEAPYDFDLFVIGAGSGGVRASRFSAQYGAKVGICELPFHPVSSEVVGGVGGTCVIRGCVPKKILVYGATFGPEIQDSREYGWKVNEKIDFDWKKLLHKKTNEIVRLNGIYKRLLSNAGVKLFEGEGRIVGPNEVEVIQLDGTRLSYSAKHILIATGSRAQRPDIPGKELAITSDEALSLEELPKRVVILGGGYIAVEFASIWRGMGSTVNLCFRKELPLRGFDDEMRALVARNLEGRGIILHPQTNITKLVKTEDGIKVTTDHGEELMADVVLFATGRAPNTKRLNLQSVGVELDRTGAVKVDEYSRTNVPSIWAIGDVTNRINLTPVALMEGTLFAKTVFGGEPSKPDYTNVPCAVFCIPPLSVVGLSEEQAIDQAEGDILVFTSTFNPMKNSISGRQEKSLMKLIVSAETDKVLGASMCGPDAAEIMQGIAVALKCGATKAQFDSTIGIHPSSAEEFVTMRSVTRRIAASGKPRNNL

SEQ ID NO: 1109 - protein, 202 aa, Cichorium intybus
MSFQDIEAGRPLNSRRGGYNNGMRKQDPTQAVASGIFQINTAVSTFQRLVNTLGTPKDTPELREKLHKTRLHIGQLVKDTSDKLKQASETDHQTDVSASKKITDAKLAKDFQAVLKEFQKAQRLSAERETAYTPFVPQSSLPSRDPDSEMDVSSDKTQEQRVLLVDSKRQEVLLLDNEIAFNEAIIEERDQGIQEIQNQIGE

SEQ ID NO: 1110 - protein, 276 aa, Cichorium intybus
MSFQDLEAGRQFNSKRGGYTNGVRKQDPTQAIASGIFQINTAVSTFQRLVNTLGTPKDTPELREKLHKTRLHIGQLVKDTSEKLKQASETDHRAEVSASKKITDAKLAKDFQAVLKEFQKAQRLAAERETAYTPFVPQAVLPSSYAASEIDISSDKSPEQRALLVESRRQEVLLLDNEIAFNEAIIEEREQGIQEIQNQIGEVNEIFKDLAVLVHEQGAMIDDIGSNIENSHAATAQARIHLSKASKTQRANSSMTCLLLVIVGIVLLIVITILAF

SEQ ID NO: 1111 - protein, 498 aa, Citrus sinensis
MARKMLNDGELSQPNQEEQTHFDFDLFVIGAGSGGVRAARFSANFGAKVGICELPFHPISSEVIGGVGGTCVIRGCVPKKILVYGASFGGELEDARSYGWEVHEKIDFDWKKLLQKKTDEILRLNGIYKRLLSNAGVKLYEGEGKIVGPNEVEVTQLDGTKLSYSAKHILIATGSRAQRAPIPGQELAITSDEALSLEELPKRAVVLGGGYIAVEFASIWRGMGSTVDLLFRKELPLRGFDDEMRAVVARNLEGRGINLHPRTTIKELIKSEEGVKVITDHGEEIVADVVLFATGRAPNTKRLNLKAVGVEVDQTGAVKVDENSRTNVPSIWAVGDVTNRMNLTPVALMEGMCFAKTVFGGQPCKPDYRDVPCAVFCIPPLSVVGLSEEQAIEQGKGDILVFTSSFNPMRNTISGRQEKTVMKLVVDAETEKVLGASMCGPEAPEIMQGIAVALKCGATKAQFDSTVGIHPSSAEEFVTMRSVTRRVAAASSNPKTNL

SEQ ID NO: 1112 - protein, 229 aa, Citrus sinensis
MTTAARPTWAPAKGGNEQGGTRIFGPSQKYSSRDLAAHTNLKPRKEGQDTKDELQKRNLRHELEERERRHFSSKDKSYNDDRDRRKSSHLLLEGTKRDMEDRAAPRSIDADDSDVEVKSDDESDDDDDDDEDDTEALLAELELIKKERAEEKLRKEKEQWEEEAKAKESELLVGNPLLNNPTSFNVKRRWDDDVVFKNQARGETKTPKRFINDTIRNDFHRKFLQKYMK

SEQ ID NO: 1113 - protein, 572 aa, Citrus sinensis
MDEDFDIPAANEMDADMDLPDDAPMMKVGEEKEIGNQGLKKKLVKEGEGWDTPENGDEVEVHYTGTLLDGTQFDSSRDRGTPFKFTLGQGNVIKGWDIGIKTMKKGENAVFTIPPELAYGESGSPPTIPPNATLQFDVELLSWTSVKDICKDGGIIKKILKEGEKWENPKDLDEVLVNYEARLEDGMVVGKADGVEFTVKDGHFCPTLAKAVKTMKKGEKVLLAVKPQYGFGEKGKSASGNEGAVPPNATLQIALELVSWKTVSEITDDKKVIKKILKEGDGFERPNEGAFVKVKLIGKLQDGTVFVKKGHSEEEQLFEFKTDEEQVIDGLDRAVITMKKNEVALLTIAPEYAFGSAESQQELAVVPPNSTVHYEVELVSFEKEKESWDMNTEEKIEAAGKKKEQGNTLFKAGKYARASKRYEKAVKYIEYDTSFGDEEKKQAKALKVACNLNNAACKLKLKDYKQAEKLCTKVLDLDSRNVKALYRRAQAYIQMADLDLAEFDIKKALEIDPDNRDVKLEYKTLKEKMKEYNKKEAKFYGNMFAKMSMFGSAESNKAEPKEAEPMSVDSKA

SEQ ID NO: 1114 - protein, 332 aa, Citrus sinensis
MARKMLNDGELSQPNQEEQTHFDFDLFVIGAGSGGVRAARFSANFGAKVGICELPFHPISSEVIGGVGGTCVIRGCVPKKILVYGASFGGELEDARSYGWEVHEKIDFDWKKLLQKKTDEILRLNGIYKRLLSNAGVKLYEGEGKIVGPNEVEVTQLDGTKLSYSAKHILIATGSRAQRAPIPGQELAITSDEALSLEELPKRAVVLGGGYIAVEFASIWRGMGSTVDLLFRKELPLRGFDDEMRAVVARNLEGRGINLHPRTTIKELIKSEEGVKVITDHGEEIVADVVLFATGRAPNTKRLNLKAVGVEVDQKRNWERGTKNSPQTFLKN

SEQ ID NO: 1115 - protein, 163 aa, Citrus sinensis
MALDIARGVSYLHHCNPPIIHRDLKSSNLLVDKHWTVKVGDFGLSRLKHETYLTTKTGKGTPQWMAPEVLRNEPSDEKSDVYSFGVILWELATEKIPWDNLNSMQVIGAVGFMNQRLEIPKDVDPRWAAIVESCWHSAGHHSRNWWTSFEICRDNTSRHLDQQ

SEQ ID NO: 1116 - protein, 250 aa, Citrus sinensis
MGDTSASTAADDDLLLKSFFAEVSEVERDNEVLRILSCFKLNPFEYLNLPFDVTPDDIKKQYRKLSLLVHPDKCKHPQAKEAFGALAKAQQLLSDEQERDYILTQVHAAKGELRAKRKKQLKKDAASKIKSLVDEGKYEQQYEQSEEFQQELKLKVREILTQQEWRRRKMQMRISEEEGRLKKDEEEQKEMWKRKREHEEQWEGTREQRVSSWRDFMKTGKKGKKGEIRPPKLKTEDPNKSYVQRPVKRG

SEQ ID NO: 1117 - protein, 274 aa, Citrus sinensis
MSFQDLEAGRPVSSLRRNLVNGKQDSTQAVASGIFQINTAVSTFQRLVNTLGTPKDTPELREKIHKTRLHIGQLVKDTSAKLKQASETDHHAQVSADKKIADAKLAKDFQAVLKEFQKAQRLAAERETAYTPFVPQAVLPSSYTAHELDISSDRSAEQHALLVESRRQEVVLLDNEIAFNEAIIEERELGIQEIQQQIGEVNEVFKDLAVLVHEQGTIIDDIGSHIENSQVATAQGKSQLVKAAKTQRSNSSLTCLLLVIFGIVLLILVVVLAA

SEQ ID NO: 1118 - protein, 188 aa, Trifolium repens
  misc_feature (177)..(177): Xaa can be any naturally occurring amino acid
  misc_feature (183)..(183): Xaa can be any naturally occurring amino acid
QDIQSGRRNLTNGKQDPTQAVASGVFQINTAVSTFQRLVNTLGTPKDTPELREKLHKTRLHIGQLVKDTSDKLKQASEIDHHADVNATKKIADAKLAKDFQAVLKEFQKAQRLAAERETAYTPFVPQAVQPSSYTVSEAGVSSDKSQEQQALLVESRRQEVISLDNEISFNEAIIEXREQGIXEIQQQ

SEQ ID NO: 1119 - protein, 236 aa, Trifolium repens
LDYEILWEDLTIREQIGQGCCGTVYHALWYGSDVAVKVFSKQEYSDDLIQSFRQEVSVMKRLRHPNILLFMGAVTSPQRLCIVTEFLPRGSLCRLLHRNTSKLDWRRRVHMALDIARGVNYLHHYNPPIIHRDLKSSNLLVDKNWTVKVGDFGLSRLKHETYLTTKTGRGTPQWMAPEVLRNEPSDEKSDVYSFGVILWELATEKIPWDNLNAMQINNGWQYSTLIPIKESCVYEV

SEQ ID NO: 1120 - protein, 274 aa, Coffea arabica
MSFQDLESGRAIGSRPRGLVNGKQDPTQAVASGIFQINTAVSTFQRLVNTLGTPKDTPELREKLHKTRLHIGQLVKDTSAKLKQASETDHRVDVSASKKITDAKLAKDFQAVLKEFQKAQRLAAERETAYTPFVPQAVQQSSYTAGETDVNSDKSSEQQALLVESRRQEILLLDNEIAFNEAIIEEREQGIQEIQQQIGEVNDIFKDLAVLVHEQGNMIDDIGSHVENAHAATAQGRSQLAKAAKTQRSNSSVTCLLLVIFGIVLLIVIVLLAA

SEQ ID NO: 1121 - protein, 273 aa, Coffea arabica
  misc_feature (194)..(194): Xaa can be any naturally occurring amino acid
  misc_feature (246)..(246): Xaa can be any naturally occurring amino acid
LPNDLGREPTDGELAEATNLDVLHLRKDIKVGQAARNKLIKHNLRLVLFVMNKYFQDFTNGPKFQDLCQAGVKGLITAIDRFEPKRKFRLSTYGLFWIRHAIIRSMTLSSLTKVSFGLDSVRIEIQRAKLELLFELQRMPTEDEIIERVGISPERYHEVMRVSNPILSLHARHSATQEEFINGITDVDGVEGEXRRQPALLRLALDDVLDSLKPKESLVIRQRYGLDGKGDRTLGEIAGNLNISRXMVRKHEVKALMKLKHPARVDYLRRYVY

SEQ ID NO: 1122 - protein, 277 aa, Coffea arabica
MGVRETDPLSQLSLPPGFRFYPTDEELLVQYLCRKVAGHDFNLQIIGEIDLYKFDPWDLPSKAIFGEKEWYFFSPRDRKYPNGSRPNRVAGSGYWKATGTDKVITTEGRKVGIKKALVFYVGKAPKGTKTNWIMHEYRLSEPSRKNGSARLDDWVLCRIYKKNSSAGAKPVSGLQSREHSHGSSTSSSSQFDDVLESLPEISDRFFALPRMNSLKNLHQDDQKINIQNLGSGSFDWATLAGLNSVAELGPGSQAQAISAAAAHGHVNNNVARCNNNR

SEQ ID NO: 1123 - protein, 368 aa, Gossypium hirsutum
  misc_feature (293)..(293): Xaa can be any naturally occurring amino acid
MDEDFDIPLVEDVNDDIDLPGDVPTLKVGEEKEIGKQGLKKKLVKEGEGWENPETGDEVEVHYTGTLLDGTKFDSSRDRGTPFKFALGQGQVIKGWDEGIKTMKKGENAIFTIPPELAYGESGSPPTIPPNATLQFDVELLSWTSVKDICKDGGLFKKILTGGEKWENPKDPDEVLVNYEAKLEDGTVVAKADGKEFTVMEGHFCPALAKAVKTMKKGEKVLLTVKPQYGFGEKGKPAGGAEGAVPPNATLQITLELVSWKTVSEVTDDKKVMKKILKEGEGYERPNEGAVVXVKLVGKLQDGTVFLKKGQDEGQELFEFRTDEEQVIDGLDKAVMTMKKGEVALLTIAPEYAFGSSGSKQELGFGTP

SEQ ID NO: 1124 - protein, 302 aa, Gossypium hirsutum
  misc_feature (262)..(262): Xaa can be any naturally occurring amino acid
TNFGYEIRISISELEDVLSDGNSPLLERWGKATCIESKLLFHLAAPAVIVYMINYLMSMSTQIFSGHLGNLELAAASLGNTGIQVFAYGLMLGMGSAVETLCGQAFGAHKYDMLGIYLQRSAVLLTFTGILLTLIYVFSKPILLLLGESPDIASAAAIFVYGLIPQIFAYALNFPIQKFLQAQSIVAPSAYISTATLFIHLLMSWVAVYKMGLGLLGASLVLSLSWWIVVVAQFVYIVKSDKCKYTWNGFSSQAFTGLPGFXQLSASSAVMLCLETWYFQILVLLAGLLETQNWLWITLHLH

SEQ ID NO: 1125 - protein, 273 aa, Gossypium hirsutum
MSFRDLEAGRPLVSRQNLINGKQDATQAVASGIFQINTAVSTFQRLVNALGTPKDTPELREKLHKTRLHIGQLVKDTSAKLKQASETDHSAGISASKKVADAKLAKDFQAVLKEFQKAQRLAAERETSYAPSVPKAVLPSSYSADEVDVGSDGGAVQQAFLLESRRQKVLLLDNEITFNEAVIEEREQGIQEIQQQIGEVNEIFKDLAVLVHEQGTMIDDIGTHIENSRAATIQAKSQLAKAAKTQRSNSSLTCLLMVIFGIVILIVVILLVV

SEQ ID NO: 1126 - protein, 273 aa, Gossypium hirsutum
MSFQDLEAGRPLGSRQNLNNGKQDATQAVASGIFQINTAVSTFQRLVNTLGTPKDTPELREKLHKTRLHIGQLVKDTSAKLKQASESDHRAEVSASKKVTDAKLAKDFQAVLKEFQKAQRLAAERETAYTPFVPQAVPSSSYTAGEVDTRSDESAEQRGLLVQSRRQEVLLLDNEIAFNEAIIEERDQGIQEIQQQIGEVNEIFKDLAVLVHEQGTMIDDIGTHIENSRAATVQAKSHLVKAAKTQRSNSSLTCLLLVIFAIVILIVIIVLAA

SEQ ID NO: 1127 - protein, 367 aa, Gossypium hirsutum
  misc_feature (287)..(287): Xaa can be any naturally occurring amino acid
  misc_feature (314)..(314): Xaa can be any naturally occurring amino acid
  misc_feature (317)..(317): Xaa can be any naturally occurring amino acid
MEDFDIPAAEDMMNEDMDLPDDSPILKVGEEKEIGNQGLKKKLVKEGEGWEYPEIGDEVEVHYTGTLLDGTQFDSSRDRGTPFKFTLGQGQVIKGWDEGIKTMKKGENAIFTIPPALAYGESGSPPTIPPNATLQFDVELLSWTSVKDICKDGGLFKKILIEGDKWENPKDLDEVLVNYEAKLEDGTAVAKAEGVEFTVKDGLFCPALARAVKTMKKGEKVLLTVKPQYGFGEKGKPATGAEGAVPPNATLLITLELVSWKTVTEVTDDKKVIKKILKEGEGYERPXEGAVVQVKLIGKLQDGTISLKKGHNEXEEXFEFKLNEEQVIEGLDRTVWNMKKSEVALLTIALNMHWGYPIQNRNWFVYR

SEQ ID NO: 1128 - protein, 496 aa, Gossypium hirsutum
MARKMLVDEEMNQTNQEEAHYDFDLFVIGAGSGGVRAARFSANYGAKVGICELPFHPISSEVIGGVGGTCVIRGCVPKKILVYGAAFGSELEDARNYGWELNEKLDFNWKKLLHKKTDEIIRLNGIYKRLLSNAGVKLFEGEGKIVGPNEVEVTQLDGTKLSYSAKHILIATGSRAHRPPIPGQELGITSDEALSLEDLPKHAVVFGGGYIAVEFASIWRGLGANVDLFFRKELPLRGFDDEMRAVVARNLEGRGINLHPQTNLTELIKTDNGIKVTTDHGEELIADVVLFATGRLPNSKRLNLEAVGVELDNTGAVKVDEYSRTSIPSIWAVGDVTNRMNLTPVALMEGTCFAKTVFGKEPSKPDYSHVPCAVFSIPPLSVVGLSEEQAIEQANGDVLVFTSTFNPMKNTVSGRQEKTVMKLVVDAETDKVLGASMCGPDAPEIMQGIAVALKCGATKAQFDSTVGIHPSAAEEFVTMRSVSRRITCSGKPKTNL

SEQ ID NO: 1129 - protein, 303 aa, Gossypium hirsutum
TVSEVTDDKKVMKKILKEGEGYERPNEGAVVRVKLVGKLQDGTVFLKKGQDEGQELFEFRTDEEQVIDGLDKAVMTMKKGEVALLTIAPEYAFGSSGSKQELASVPPNSTVYYEVEMVSFIKDKESWDMNTPEKIEAAGKKKEEGNVLFKSGKYARASKRYEKAVKYIDYDSSFSEEEKKQAKALKVACNLNNAACKLKLKDFKQAEKLCTKVLEIESSNVKALYRRAQAYIHLADLDLAEFDVKKALEIDPDNREIKMEYKLLKEKMKEYNKKEAKFYGNMFAKMNKTAPKEPAPMTIDSKA

SEQ ID NO: 1130 - protein, 572 aa, Gossypium hirsutum
  misc_feature (421)..(421): Xaa can be any naturally occurring amino acid
MEDFDIPAAEDMMNEDMDLPDESPILKVGEEKEIGNQGLKKKLVKEGEGWEYPEIGDEVEVHYTGTLLDGTQFDSSRDRGTPFKFTLGQGQVIKGWDEGIKTMKKGENAIFTIPPALAYGESGSPPTIPPNATLQFDVELLSWTSVKDICKDGGLFKKILIEGDKWENPKDLDEVLINYEAKLEDGTVVAKAEGVEFTVKDGLFCPALARAVKTMKKGEKVLLTVKPQYGFGEKGKPATGAEGAVPPNATLLITLELVSWKTVTEVTDDKKVIKKILKEGEGYERPNEGAVVQVKLIGKLQDGTIFLKKGHNEGEELFEFKTDEEQVIEGLDRAVLNMKKGEVALLTIAPEYAFGSSESKQELAVVPPNSTVYYEVELVSFVKEKESWDLNTQEKIEAAGKKKEEGNVLFKAGKYVRASKXYEKAVKYIDYDTSFSEEEKKQSKALKVACNLNDAACKLKLKDYKQAEKLCTKVLELESANVKALYRRAQAYINLADLDLAELDIKKALELDPDNREVKLEYKALKEKIKEYNKKEAKFYGNMFAKMNKMDSGDSSKSAAKEPEPMSIDSKA

SEQ ID NO: 1131 - protein, 236 aa, Gossypium hirsutum
  misc_feature (197)..(197): Xaa can be any naturally occurring amino acid
  misc_feature (206)..(206): Xaa can be any naturally occurring amino acid
  misc_feature (224)..(224): Xaa can be any naturally occurring amino acid
  misc_feature (232)..(234): Xaa can be any naturally occurring amino acid
MGKRKTQRNNAAMLDSDDDNSSVSSSSTMRSAGMSVSGTEEVELNKDSLLDEAVDNLYEKRGSTREKALASIIEAFNSNLQHEFVEKKFATLLHRCLNSIKKGSSKEISLASHTIGLLALTIGPGDKAREILEESITPVSQAFKSGYESSKIASLLECLAIITFVGGIEPEETEKSMQIMWQLVHPKLGSNVITVKXSAVVITAVXSAWSFLLTTMDRWSLSPXLWLKSSHXXXVC

SEQ ID NO: 1132 - protein, 389 aa, Gossypium hirsutum
  misc_feature (293)..(293): Xaa can be any naturally occurring amino acid
  misc_feature (345)..(345): Xaa can be any naturally occurring amino acid
  misc_feature (348)..(348): Xaa can be any naturally occurring amino acid
  misc_feature (351)..(352): Xaa can be any naturally occurring amino acid
  misc_feature (358)..(358): Xaa can be any naturally occurring amino acid
  misc_feature (363)..(363): Xaa can be any naturally occurring amino acid
  misc_feature (366)..(366): Xaa can be any naturally occurring amino acid
  misc_feature (368)..(369): Xaa can be any naturally occurring amino acid
  misc_feature (374)..(374): Xaa can be any naturally occurring amino acid
MDEDFDIPLVEDVNDDIDLPGDVPTLKVGEEKEIGKQGLKKKLVKEGEGWENPETGDEVEVHYTGTLLDGTKFDSSRDRGTPFKFALGQGQVIKGWDEGIKTMKKGENAIFTIPPELAYGESGSPPTIPPNATLQFDVELLSWTSVKDICKDGGLFKKILTGGEKWENPKDPDEVLVNYEAKLEDGTVVAKADGKEFTVMEGHFCPALAKAVKTMKKGEKVLLTVKPQYGFGEKGKPAGGAEGAVPPNATLQITLELVSWKTVSEVTDDKKVMKKILKEGEGYERPNEGAVVXVKLVGKLQDGTVFLKKGQDEGQELFEFRTDEEQVIDGLDKAVMTMKKRGKFXLVXIFXXLKNPFXGIFPXSKXGXXGLPGXPPQPPPRVVIFVGRG

SEQ ID NO: 1133 - protein, 310 aa, Gossypium hirsutum
  misc_feature (86)..(86): Xaa can be any naturally occurring amino acid
AITSDEALSLLFIPKRAVVFGGGYLAVEFASIWRGLGATVDLFYRKELPLRGFDDEMRAVVARNLEGRGIKLHPQTNLMELVKTDXGIKVITDHGGELIADVVLFATGRLPNTKRLNLEAVGVEIDKTGAVKVDEYSRTNIPSIWAVGDVTNRMNLTPVALMEGTCFATTVFGGESSKPDYRNIPCAVFSIPPLSIVGLSEEEAIEQVNGDVLVFTSTFNPMKNTVSGRQEKTIMKLVVDAETDKVLGASMCGPDAPEIMQGIAVALKCGATKAQFDSTVGIHPSAAEEFVTMRSVSRRVTARGKAKTNL

SEQ ID NO: 1134 - protein, 256 aa, Gossypium hirsutum
  misc_feature (13)..(13): Xaa can be any naturally occurring amino acid
  misc_feature (90)..(90): Xaa can be any naturally occurring amino acid
  misc_feature (164)..(164): Xaa can be any naturally occurring amino acid
DEMRAVVARNLEXRGINLHPQTNLTELIKTDNGIKVTTDHGEELIADVVLFATGRLPNSKRLNLEAVGVELDNTGAVKVDEYSRTSIPSXWAVGDVTNRMNLTPVALMEGTCFAKTVFGKEPSKPDYSHVPCAVFSIPPLSVVGLSEEQAIEQANGDVLVFTSXFNPMKNTVSGRQEKTVMKLVVDAETDKVLGASMCGPDAPEIMQGIAVALQCGATKAQFDSTVGIHPSAAEEFVTMRSVSRRITCRGKPKTNL

SEQ ID NO: 1135 - protein, 272 aa, Gossypium hirsutum
MSFQDLEAGRPFASRQNMINGKQDASQAVASGIFQINTAVSTFQRLVNTLGTPKDTPELREKLHKTRLHIGQLVKDTSAKLKQASETDHHAEVSTSKKITDAKLAKDFQAVLKEFQKAQRLAAERETSYSPFVPQSALPASYTAGEMDASSDKSAEQRALLVERRQEVVLLDNEIAFNEAIIDEREQGIQEIQQQIGEVNEIFKDLAVLVHEQGTMIDDIGTHIENSQAATSQAKSHLVKAAKSQRSNSSLACLLLVIFGIVLLIVIIVLAA

SEQ ID NO: 1136 - protein, 237 aa, Vigna unguiculata
STPPSPPSRDSSTPSEPPNTPELREKLHKTRLHIGQLVKDTSAKLKQASDIDHRAEVNASKKIADAKLAKDFQAVLKEFQKAQRLSAERETAYTPFVPQAVLPSSYTAGELGVGSDKSPEERALLVESRRQEVLFLDNEIAFNEAIIEEREQGIQEIQQQIGEVNEIFKDLAVLVHEQGTMIDDIGSNIENSHAATAQAKSQLLKASKTQRSNSSLTCLLLVIFGIVLLIVIIVLAA

SEQ ID NO: 1137 - protein, 261 aa, Vigna unguiculata
GFEDGWKSRWVLSDWKRSEGKAGTFKHTAGKWSGDPDDKGLQTHNDAKHFAISAKIPEFSNKDRTLVVQYSIRFEQDIECGGGYIKLHSGYVNQKKFGGDTPYSLMFGPDICGTQTKKLHLILSYQGQNYPIRKELQCETDKLTHFYTFILRPDASYSILVDNRERDSGSMYADWDILPPRKIKDVKAKKPADWDGREYIEDPNDVKPEGYDSIPAEIPDPKAKKPADWDDDDDGLWKPKKIPNPAYKGPWKRKKIKNPNY

SEQ ID NO: 1138 - protein, 499 aa, Vigna unguiculata
MARKMLIDGEAESVPGVEQGTNFDFDLFIIGAGSGGVRAARFSSNYGAKVGICELPFNPISSETIGGVGGTCVIRGCVPKKILVYGASYGGELEDARNYGWELNEKVDFNWKKLLQKKTDEINRLNGIYKRLLSNAGVKLFEGEGKIVGPNEVEVTQLDGTKLSYTAKHILIATGSRAQRPNIPGQELGITSDEALSLEDLPKRAVVLGGGYIAVEFASIWRGMGSEVDLVFRKELLLRGFDDEMRAVVARNLEGRGINLHPRTNLTQLIKTENGIKVITDHGEELIADVVLFATGRAPNSKRLNLEAVGVEVDKAGAIKVDEYSRTSIPSIWAVGDVTNRMNLTPVALMEASCFAKTVFNGQASKPDYSNIACAVFSIPPLSVVGLSEEQAIEQTKGDLLIFTSTFNPMKNTISGRQEKTEVMKLIVDAETDKVLGASMCGPDAPEIIQGIAIALKCGATKEQFDSTVGIHPSAAEEFVTMRTVTRRVTGSGKPKTNL

SEQ ID NO: 1139 - protein, 224 aa, Vigna unguiculata
DTFFFPRQTTISALFCIFSVAKKKKMWKKMGFEEEAVVELINSDFRDLSVAANQLANHVVKLGGIGFGASFFGLIAAIAAIYLLILDRTNWRTNILTALLIPYIFFSLPSIIFAVFRGEIGKWIAVIAVVLRLFIPRHFPDWLELPGALILLIVVAPSLFANTFRNDIVGVVVCLIIACYLLQEHIRASGGFRNSFTKAHGISNSIGIILLLVYPIWALVVILF

SEQ ID NO: 1140 - protein, 438 aa, Vigna unguiculata
PELAYGESGSPPTIPPNATLQFDVELLSWTSVKDICKDGGIFKKILTEGEKWENPKDPDEVLVKYEARLEDGKLVGKSDGVEFTVREGHYCPALSKAVKTMKKGEKVVLTVKPQYGFGEKGKPAQAEEGAVPPNASLEITLELVSWKTVTEVTDDKKVIKKILKEGEGYERPNEGASVKVKLIGKLQDGTTFLSKGHDEEEKLFEFKTDEEQVVDGLDRAVLTMKNGEVALLTIAPEYAFGSSESQQELAVVPPNSTVYFEVELVSFEKEKESWDLNTEEKLEAANKKKEEGNVLFKAGKYARASKRYEKAVKYIEYDSAFGEEEKKLAKTLKVACNLNNAACKLKLKDYKEAEKLSTKVLDLESTNVKALYRRAQAYMQLSDLDLAELDIKKALEIDPNNRDLKLEYRTLREKVKENNRKEAKFYGNMINKLTKIGS

SEQ ID NO: 1141 - protein, 496 aa, Taraxacum officinale
  misc_feature (479)..(479): Xaa can be any naturally occurring amino acid
MSRKMLIDGDLDDTTGDIDYDFDLFVIGAGSGGVRASRFSAQYGAKVGICELPFHPISTEVVGGVGGTCVIRGCVPKKILVYGATFGPEIQDSKEYGWKVNDNIDFDWKKLLHKKTEEIVRLNGIYKRLLSNAGVKLFEGEGRIVGPNEVEVIQLDGTKLSYSAKHILIATGSRAQRPNIPGWELAITSDEALSLEELPKRVVILGGGYIAVEFASIWRGMGSTVNLCFRKELPLRGFDDEMRALVARNLEGRGIILHPQTNITQLVKLEDGSIKVTTDHGEELIADVVLFATGRAPNTKRLNLESVGVELDRSGAIKVNEYSRTNVPSIWAIGDVTNRINLTPVALMEGTFFAKTVFGNEPSKPDYSNVPCAVFCIPPLSVVGLSEEQAIEQAEGDILVFTSTFNPMKNSISGRQEKSLMKLIVSAETDKVIGASMCGPDAAEIMQGIAVAVKCGATKAQFDSTIGIHPSSAEEFVTXRSVTRRIAASGKRKTNL

SEQ ID NO: 1142 - protein, 251 aa, Taraxacum officinale
  misc_feature (4)..(4): Xaa can be any naturally occurring amino acid
  misc_feature (24)..(25): Xaa can be any naturally occurring amino acid
  misc_feature (30)..(32): Xaa can be any naturally occurring amino acid
  misc_feature (104)..(104): Xaa can be any naturally occurring amino acid
  misc_feature (235)..(235): Xaa can be any naturally occurring amino acid
  misc_feature (246)..(246): Xaa can be any naturally occurring amino acid
MSFXDIEAGRPLNSRRAGYTGMKXXDPTQXXXYGIFQINTAVSTFQRLVNTIGTPKDTPELRDKLHKTRLHIGQLVKDTSEKLKQASEADHRTEVSASKKITDXKLAKDFQAVLKEFQKAQRLSAERETAYSPSVPQPILPSRNEASEDASSGTSPEQRALLVDRRQEVLLLDNEIAFNEAIIEERDQGIQEIQNQIGEVNEIFKDLAVLVHEQGTMIDDIGSISRTLMLQLYRXNPILLKHQRLXNQTLP

SEQ ID NO: 1143 - protein, 144 aa, Taraxacum officinale
MSFQDLESGRQFNSKRDGYTNGVRKQDPTQAIASGIFQINTAVSTFQRLVNTLGTPKDTPELREKLHKTRLHIGQLVKDTSEKLKQASETDHRAQVTASKKITDAKLAKDFQAVLKEFQKAQRLAAERETAYTPFVPQAVLPSR

SEQ ID NO: 1144 - protein, 201 aa, Taraxacum officinale
MSFQDIEAGRPLNSRRGGYNNGMRKQDPTQAVASGIFQINTAVSTFQRLVNTLGTPKDTPELREKLHKTRLHIGQLVKDTSDKLKQASETDHNTDVSASKKITDAKLAKDFQSVLKEFQKAQRLSAERETAYTPFVPQSSLPSRDPDSEMDVSSDKIQEQRVLLVDSKRQEVLLLDNEIAFNEAIIEERDQGIHEIQNQIE

SEQ ID NO: 1145 - protein, 259 aa, Taraxacum officinale
MSFQDLESGRQFNSKRDGYTNGVRKQDPTQAIASGIFQINTAVSTFQRLVNTLGTPKDTPELREKLHKTRLHIGQLVKDTSEKLKQASETDHRAQVTASKKITDAKLAKDFQAVLKEFQKAQRLAAERETAYTPFVPQAVLPSSYAASEMDISSDKNPEQRALLVESRRQEVLLLDNEIAFNEAIIEEREQGIIEIQNQIGEVNEIFKDLAVLVHEQGAMIDDIGSNIENSHAATSQARVHLSKHRKLKGQIRHDLLAY

SEQ ID NO: 1146 - protein, 88 aa, Festuca arundinacea
GTRLNYLFVKAMYAGTSISAGMKGASKAMAAMNKQMEPTKQMKVMREFQKQSTQLDMTLEMMSDAVDETLDKDEAEEETEELTNQVKC

SEQ ID NO: 1147 - protein, 117 aa, Festuca arundinacea
MTMRPLIFLALAVLLAGVALEGGAEAAGECGRSSPDRMALRMAPCISAADDPESAPTGSCCSAVHTIGKSPSCLCAVMLSGTAKMAGIKPEVAISIPKRCNIADRPVGYKCGDYTLP

SEQ ID NO: 1148 - protein, 199 aa, Festuca arundinacea
MGSSEADDDLLLKSFLAEVSEAERDNEVLRILGCFKLNPFEHLKLSFDSSPDEVKKQYRKLSLLVHPDKCKHPQAQEAFGALSKAQQLLLDPQERGYILDQVTAAKEELRAKRKKELRKDSASKIKSQVDEGKYEDQFERSDEFHKQLIIKVREILTDKEWRRRKMQMRISEEEGRLKKDEEETKEMWKRKREHEEKWE

SEQ ID NO: 1149 - protein, 319 aa, Festuca arundinacea
  misc_feature (73)..(73): Xaa can be any naturally occurring amino acid
GTRENITIASALITKSFGDRLRKAVEKGDMVNVNLDWRESLPHPDERVEYEFWTNSNDECGPKCDSQIDFVKXFKGPAQILEKKGYTQFTPHYITWYCPESFTLSKQCKSQCINHGRYCAPDPEQDFSKGYDGKDVVVQNLRQVCVYQVAKDSQKPWLWWDYVTDFAIRCPMKENKYTKECADGVIKSLGLDHKAIDKCIGDPDADEENPVLKAEQDAQIGKGACGDVTILPTLVINNRQYRGKLDKGAVLKALCAGFKETTEPAVCLSEDIQTNECLENNGGCWHDKAANISACKDTFRGRVCECPVVKGVKFVGDGY

SEQ ID NO: 1150 - protein, 76 aa, Festuca arundinacea
MAAAAPADPKAEAAKMDLLEDDDEFEEFEIDQEWDDKEDGNEAVQQWEDDWDDDDVNDDFSLQLRKELEEGSAPKN

SEQ ID NO: 1151 - protein, 338 aa, Festuca arundinacea
HEGTFKHTAGKYSGDPDDKGIQTTLDARHFAISAKIPEFSNKGRTLVLQYSIKFEQDIECGGGYIKLMSGYVNQKKYSGDTPYSLMFGPDICGTQTKKLHLILSYQGQNYPVKKDLQCETDRLTHVYTFILRPDASYSILVDNRERESGSMYTDWDILPPRKIKEVNAKKPKDWDDREYIEDPDEVKPEGYDSIPREIPDPKDKKPDTWDDDDDGIWKPRRIPNPAYKGQWKRKKIKNPNYKGKWKIPWIDNPEFEDDPDLYVLKPVKYIGIEVWQVKAGSVFDNILICDDPEYAKRAAEETWGANKEAEKEAFEEAEKERKAREDKEAQQAREEGER

SEQ ID NO: 1152 - protein, 180 aa, Festuca arundinacea
  misc_feature (151)..(151): Xaa can be any naturally occurring amino acid
  misc_feature (156)..(156): Xaa can be any naturally occurring amino acid
MTTAARPTWAPAKGGNEQGGTRIFGPSGKYSSRDLAAHTSLKPRKEGQQTQEEVQKRNLRDELEERERKHFSSKDKSYVDERDWRKSSGLLLEGSKRDEDKIVPREIDADDSDVELRSDDESDDDDDDDDTEALMAELERIKKERAEDKLXKDRQXAEEEAKMKEAELMRGNPLINMNNA

SEQ ID NO: 1153 - protein, 411 aa, Festuca arundinacea
  misc_feature (274)..(274): Xaa can be any naturally occurring amino acid
HEGAKVAICELPFHPISSEWLGGHGGTCVIRGCVPKKILVYGASFRGEFEDSKQFGWEISGDINYNWKKLLENKTQEIVRLNGVYKRILGNSGVTMIEGAGSIVDAHTVEVTQPDGSKQRHTAKHILIATGSRATRVNIPGKELAITSDEALSLEELPKRAVILGGGYIAVEFASIWRGLGAEVDLFYRKELPLRGFDDEMRTIVASNLEGRGIRLHPGTNLTELSKTADGIKVVTDKGDELIADVVLFATGRAPNSNRLNLEAVGVEVDQVGXIKVDEYSRTSVPNIWAVGDVTNRINLTPVALMEATCFSKTVFGGQPIKPDYKDVPCAVFCIPPLSVVGLSEQEALAEAKNDILVYTSSFNPMKNSISKRQEKSVMKLVVDAETDKVLGAAMSGPDAAEIMQGIAVAL

SEQ ID NO: 1154 - protein, 219 aa, Festuca arundinacea
HEASTTTTTTSAATTMSPFRGALLVLAVFVAACLGAAAADQPGSAEGYTIAGRIKIDAASAKGFGLPAKTSNTKVILNGGQKVTFARPDGYFAFHNVPAGTHLIEVSSLGYFFSPVRVDISARNPGHIQAALTENRRVLNELVLEPLKAEQYYEVREPFNIMSLLKSPMGLMVGFMVLMVFVMPKMMENIDPEEIKQAQEQMRNSPVPSFSGLLARANS

SEQ ID NO: 1155 - protein, 144 aa, Zingiber officinale
TRAKQELKVKKKKELKKDNASKIKAMLDEGKSEQQYEQSQEFKQQLKIKVREILTEQEWRRRKMAMRISEEEGRLKKDEEETKEMWKRKREHEEQWEETRDKRVSSWRDFMKTGKKGKKGEIRPPKLKTEDPNKSYVQRPVNRG

SEQ ID NO: 1156 - protein, 207 aa, Vitis vinifera
FEYLNIPFDSSPDDVKKQYRKLSLLVHPDKCKHPQAKEAFGALAKAQQLLLDPQEREYLLSQVNAAKEELRAMRKKQLKKDNASKIKSLVDEGKYEQEYERSEEFQKQLKLKVRELLTEQEWRRRKMQMRISEEEGRLKKDEEDTKEMWKRKREHEEQWEGTREQRVSSWRDFMKTGKKGKKGEIRPPKLKTEDPNKSYVQRPVKRG

SEQ ID NO: 1157 - protein, 231 aa, Vitis vinifera
FQMLAPPPEGTFDLDEQHLPIKGCPKDGSPEQVPLLTQEVLSSDLNASKQGKIKDFLVYMYDKLKIKQILQPPIIASILALAIGAIPFLKKLIFTPNAPLFFFTDSLIILGEAMIPCILLALGGNLVDGPGSSKLGLRTTTAIIFGRLVLVPPAGIGIVLLADKLGFLPPDDKMFRFVLLLQHSMPTSVLSGAIANLRGCGRESAAVLFWVHIFAIFSMAGWIVLYLHILF

SEQ ID NO: 1158 - protein, 469 aa, Carpobrotus edulis
TRIDGEAAMQSQSNDEDNNAHYDFDLFVIGAGSGGVRAARFSAKFGAKVGICELPFHPISSEVIGGVGGTCVIRGCVPKKILVYGASFSGELQDARNYGWELNENIDFNWKKLLQKKTDEILRLNNIYKRLLSNAGVKLYEGEGKIVSPNEVQVTQLDGTKLSYSAKHILIATGSRAQRPDIRGQELAITSDEALSLEELPKRAVILGGGYIAVEFASIWRGMGATVDLFFRRELPLRGFDDEMRAVAARNLEGRGVNMHPRTNLTELVKTDGGIKVRTDHGEELMADVVLFATGRSPNTKRLNLDAVGVNVDKTGAIKVDDYSQTSVPSIWAIGDVTNRMNLTPVALMEGTCFAKSLFGGQPTKPDYKDIPCAVFSIPPLSVVGLSEEQAIEQSNGDVLVFTSSFNPMRNTISQRQEKSVMKLVVDAETDRVLGASMCGPDAPEIMQGIAVALKCGATKAQFDSTVSR

SEQ ID NO: 1159 - protein, 223 aa, Carpobrotus edulis
  misc_feature (165)..(165): Xaa can be any naturally occurring amino acid
MGVQEKDPLAQLSLPPGFRFYPTDEELLVQYLCRKVAGHHFSLQIIAEIDLYKFDPWILPSKAIFGEKEWYFFSPRDRKYPNGSRPNRVAGSGYWKATGTDKVITTQGRKVGIKKALVFYIGKAPKGTKTNWIMHEYRLTEPTRKHGSSKLDDWVLCRIYKKTSXAAAAAARTESSKEQSTGGSSSSSSSHLDDVMEVVSLPEINDRSFALPRMNSLKPRVNP

SEQ ID NO: 1160 - protein, 155 aa, Ipomoea batatas
  misc_feature (11)..(11): Xaa can be any naturally occurring amino acid
  misc_feature (17)..(17): Xaa can be any naturally occurring amino acid
  misc_feature (150)..(150): Xaa can be any naturally occurring amino acid
  misc_feature (153)..(153): Xaa can be any naturally occurring amino acid
MSFQDLESGRXIGSRRXYSNGKQDPTQAVASGIFQINTAVSTFHRLVNTLGTPKDTPELREKLHKTRLHIGQLVKDTSAKLKQASETDHRSEVSASKKITDAKLAKDFQAVLKEFQKAQRLAAERETAYTPFVPQAVLPSSYTASEIDVXSYXNP

SEQ ID NO: 1161 - protein, 75 aa, Ipomoea batatas
MATEQPKPAPEDVKMDLFEDDDEFEEFEIDQEWEDKEEGKEVTQQWEDDWDDDDVNDDFSLQLRKELECNTEKKD

SEQ ID NO: 1162 - protein, 220 aa, Ipomoea batatas
PMKAPNRDSSHAAAKDSSPEQIPLLAQEPAVPVSTSSQKNKIKEFFKFLYEKLKLKQIIQPPIIASVLAIFLGCVPFFKKLIFTSDAPFYFFTDSCMILGEAMIPCILLALGGNLVQGPGSSKLGLRTTAAIIFGRLVLVPPTGLGIVMLADKLGFLPAGDKMFRFVLLLQHTMPTSVLSGAVANLRGCGREAAAVLFWVHIFAIFSMAGWIILYLNILF

SEQ ID NO: 1163 - protein, 276 aa, Lactuca sativa
MSFQDLEAGRQFNSRRGAYANGVRKQDPTQAIASGIFQINTAVSSFQRLVNTLGTPKDTPELREKLHKTRLHIGQLVKDTSEKLKQASETDHRAEVSTSKKITDAKLAKDFQAVLKEFQKAQRLSAERETAYTPFVPQAVLPSSYAASEMDINSDKNPEQRALLVESRRQEVLLLDNEIAFNEAIIEEREQGIQEIQNQIGEVNEIFKDLAVLVHEQGAMIDDIGSNIENSHAATAQARIQLSKASKTQKANSSMTCLLLVIVGIVLLILITILAF

SEQ ID NO: 1164 - protein, 265 aa, Lactuca sativa
MSFQDIEAGRPLNSRRAGYTGMKPQDPTQAIASGIFQINTAVSTFQRLVNTLGTPKDTPELREKLHKTRLHIGQLVKDTSEKLKQASETDHRAEVSASKKITDAKLAKDFQAVLKEFQKAQRLAAERETAYSPAVPQAIHSSRNEAGEVDASSGRSPEQHALLVQSKRQEVLLLDNEIAFNEAIIEERDQGIQEIQNQIGEVNEIFKDLAVLVHEQGTMIDDIGSNIENSHAATLQGKSHLAKASKTQRSNSSMTCLLMVILGIV

SEQ ID NO: 1165 - protein, 271 aa, Lactuca sativa
  misc_feature (260)..(260): Xaa can be any naturally occurring amino acid
MSKNGAGRSALQQKFQSGALVLVFLSICTLSFSEVIFEERFDDGWQSRWVKSDWKKSEGKAGSFKHTAGSWSGDPDDKGIQTSVDARHTAISAKIPEFNNKNRTLVLQYSIKFEQDIECGGGYIKLMSGYVNQKKFGGDTPYSVMFGPDLCGTQTKKLHVIVSYQGQNYPIKKDLQCETDKLTHFYTFVLRPDASYSILIDGRERDSGSMYTDWDILPPRKIKDLKAKKPLDWEEREYIEDPDQVKPEGYDSIPREIPDXKAKKPDTWDED

SEQ ID NO: 1166 - protein, 568 aa, Lactuca sativa
MDEDFDIPVADEMNDEFMDDIEAPVTLKVGEEKEIGNQGLKKKLLKEGEGWDTPESGDEVEVHYTGTLLDGTQFDSSRDRGTPFKFTLGQGQVIKGWDLGIKTMKKGENALFTIPADLAYGEAGSPPTIPPSATLQFDVQLLSWVSVKDICKDGGIFKKIVKEGEKWENPKDLDEVLVNYEVQLEDGTVVAKSDGVEFKVEDGHFCPALAKAVKTMKKGEKVILTVKPEYGFGEKGKPEGSIPANATLQITLELLSWKVVTNVTDDKKVIKKILKEGEGYERPNEGAVVQVKLIGKLQDGTLFIKKGHDDSEPFEFKADEEQVIDGLDKAVMTMKKGEVALLTIAPEYAFGSTDSKQELAVVPPNSTVTYEIELVSFVKDKESWDMTTTQEKIEAAGKKKEEGNAFFKAGKYLKAVKRYEKAAKFIEYDTNFEEDEKKQAKALKITCNLNNAACQLKLKDYKQAEKLCTKVLELESTNVKALYRRAQAYINVADLDLAEIDVKKALEIDPNNKDVKHEYKLLKEKIKEYNKKDAKFYGNMFAKMTKPSSNKAAGTKEAEEPMSVDSKA

SEQ ID NO: 1167 - protein, 417 aa, Lactuca sativa
MHRLLSEILMDTQGGGESLLGSIKIAVLPIAKVFTMCFLGFLMASKYVNILPASGRKLLNGLVFSLLLPCLIFSQLGQAITFEKMIEWWFIPFNVILATISGSLIGLLVACIVRPPYPYFKFTIIHIGIGNIGNVPLVLIAALCRDKSNPFGDSATCTRDGNAYISFGQWVGAIVLYTYVFQMLAPPPGGSFEIEDTKNLPIKNPPKTNTNTNNPPEEVPLLTHEPESIDQDTPKDGKIKQFMKFLYDKLKLKQILQPPIIASILAIFIGCIPFLKGLIFTPDAPLYFFTDSCLILGDAMIPCILLALGGNLTDGPGSSKLGLKTTAAIIFGRLVLVPPAGLGIVTLADKLGLLPPDDKMFRFILLLQHSMPTSVLSGAVASLRGCGREAAAILFWVHIFAIISMAGWIVLYLNILF

SEQ ID NO: 1168 - protein, 156 aa, Lactuca sativa
MGLPVTDPMTQLSLPPGFRFFPTDEELLVQYLCRKVAGHDFSLQIIADIDLYKFDPWELPSKAMFGEKEWYFFSPRDRKYPNGSRPNRVAGSGYWKATGTDKVITTGGRRVGIKKALVFYVGKAPKGNKTNWIMHEYRLSEPQRKNGSSRVSPINL

SEQ ID NO: 1169 - protein, 255 aa, Lactuca sativa
  misc_feature (194)..(194): Xaa can be any naturally occurring amino acid
  misc_feature (237)..(237): Xaa can be any naturally occurring amino acid
MSFQDLEAGRQFNSRGGGYANGVRKQDPTQAIASGIFQINTAVSSFQRLVNTLGTPKDTHELREKLHKTRLHIGQLVKDTSEKLKKASETDHRAEVSTSKKITDAKLAKDFQAVLKEFQKAQRLAAERETAYSPFVPQAVLPSSYAASEIDISSDKHPEQRALLVESRRQEVLLLDNEIAFNEAIIEEREQGIXEIQNQIGEVNEIFKDLAVLVHEQGAMIDDIGSNIENSHASTAXARIQLSKHQTQKQIFMTC

SEQ ID NO: 1170 - protein, 448 aa, Lactuca sativa
  misc_feature (321)..(321): Xaa can be any naturally occurring amino acid
  misc_feature (392)..(393): Xaa can be any naturally occurring amino acid
  misc_feature (399)..(399): Xaa can be any naturally occurring amino acid
  misc_feature (421)..(421): Xaa can be any naturally occurring amino acid
MSRKMLIDGDLDNLSGENDYDFDLFVIGAGSGGVRASRFSAQYGAKVGICELPFHPVSSETIGGVGGTCVIRGCVPKKILVYGASFGPEIQDAKEYGWKVNDNIDFDWKKLLHKKTEEIVRLNGIYKRLLSNAGVKLFEGEGRIVGPNEVEVIQLDGTKLSYSAKHILIATGSRAQRPNIPGQELAITSDEALSLEELPKRVVILGGGYIAVEFASIWRGMGSTVNLIFRKELPLRGFDDEMRALVARNLEGRGIILHPQTNITQLVKTEDGIKVTTDHGEELMADVVLFATGRVPNTKRLNLQSVGVEVDKTGAVKVDEXSRTNVPSIWAIGDVTNRMNLTPVALMEGTLFAKTVFGNEPSKPDYSNIPCAVFCIPPLSVVGLSEEQAIEXXEGDILXFTSTFNPMKNSISGRQEKTLMXLIVSAETDKVIGASMCGPDAAEIMQGI

SEQ ID NO: 1171 - protein, 148 aa, Lotus japonicus
MSFQDIEAGRPFGSRCGPINGKQDPTQAVAAGIFQINTAVSTFQRLVNTLGTPKDTPELREKLHKTRLHIGQLVKDTSAKLKQASDIDHHVEVNASKKIADAKLAKDFQAVLKEFQKAQRLAAERETAYTPFVPQAVLPSSYTASEVD

SEQ ID NO: 1172 - protein, 173 aa, Lotus japonicus
MGVPEKDPLAQLSLPPGFRFFPTDEELLVQYLCRKVAGYHFSLPIIAEIDLYKFDPWVLPGKAIFGEKEWYFFSPRDRKYPNGSRPNRVAGSGYWKATGTDKVITTEGRKVGIKKALVFYIGKAPKGTKTNWIMHEYRLLDSSRKHKLGSSRLDEWVLCRIYKKKSSTQKEAA

SEQ ID NO: 1173 - protein, 229 aa, Zea mays
MTTAARPTWAPAKGGNEQGGTRIFGPSQKYSSRDLAAHTSLKLRKDGQQTQEELQKRNLREELEERERKHYSSKDKSYAERDRRKSSSQLLLEGSKREAEDKIVPREIDADDSDVEPKSDDESDEDGDDDDTEALMAELERIKKERAEEKLRKERQQAEEEAKMKEAELMRGNPLININNPGSFSVKRRWDDDVVFKNQARGETKTPKRFINDTIRSDFHRKFLHRYMK

SEQ ID NO: 1174 - protein, 420 aa, Zea mays
LLVDSGDHNVVNDIFRRISMGESWTGKFPVKSKQGDRFSAVATNTPFYDEDGSLVGIICVSSDSRHLEQIFCKPPTSARPQSESSRTSCDGSCSNTSRRINLLNRSPFDPQIPLQSTFASRITNLATKVTNKVRSRVSTDDYGIEREGGSGESHCSDRGAKEEPTSSGTNTPRGNAPHGPFSTDENSPGKSTNPSSDELEGKVGLHKFLSSKAEALLNKKGISWPWKVRENDGPDERNHVILLHGDQENVMNHQKVSDSSIAPDSQGAEHNLPSKNEASGSWSSYNNNSTSSASSTGSTNSSALYKVDHEADCLDYEILWEDLVIGEQIGQGSCGTVYHALWYGSDVAVKVFSRQEYSEDVILSFRQEVSLMKKLRHPNILLFMGAVTSPQRLCIVTEFLPRYVPTFFYGHTCLQVFLIL

SEQ ID NO: 1175 - protein, 402 aa, Zea mays
FGTSFGCCGFVMAAAAICVEDEAACAAAECAGIGNLDLAAAGAGAGGKRSVYLMDCAPVWGCASTRGRSTEMEDACAAAPRFADVPVRLLASRRDLDRLGLDADTLRLPAHLFGVFDGHGGAEVASYCRERLQVLLRQELRLLSKDLGETSEADMKEHWDELFTRCFQRLDDEVSGQASRLVGGVQETRPVAAENVGSTAVVAVVCSSHVVVANCGDSRVVLCRGKEPLELSIDHHPDRKDERARIEALGGKVIQWNGYRVSGILAMSRSIGDRYLKPFVIPKPEVTVVPRAKDDDCLILASDGLWDVVTNEEACKAARRQIQVWHKNNGAAGALWSLCDEGDGSTTDPDAQAAADYLVRVALKKGTEDNVPVIVVDLNPRKKSSGATRSIGRSGSITVELS

SEQ ID NO: 1176 - protein, 266 aa, Zea mays
MAPRLLACFGRGVAAAPDDATGEGQLEAPPAGPVLVELFGSQGCGASPEADAVAARLAQDSGSGDGAVVVLAFHVDYWDYRGWKDPFASSAWTVRQKAYVEALRLDTLFTPQVVLQGRAHCVGTDQDALALAVRDAPRYPAPAIKVTFQRPSPATLQASFTGTLRSRVEGPGGASVLVALYESGLVTDCGRGENKGKSLLNDHVVRRLEKVAAVREGASPKKTVSGTVQFPLWDGFRATKCGLVLFVQNAALQVLGVQHFDLPDNV

SEQ ID NO: 1177 - protein, 126 aa, Zea mays
FDLAFVFGTSPSPTPIARAPAPKQPPGLARVSSPPLALILSRHATREGAAFMAATPADAKTEAAKMDLLEDDDEFEEFEIDQEWDEKEEGNEAVQQWEDDWDDDDVNDDFSLQLRKELEGSNAQKS

SEQ ID NO: 1178 - protein, 229 aa, Zea mays
MNIFKKKVDPKEALRTSKREMAVATRGVEREIGSLQMEEKKLVAEIKKTAKTGNEAATKILARQLVRLRQQILNLQGTRAQIRGVATHTQAMYAGTSISAGMKGASKAMSAMNKQMEPAKQIKVMKEFQKQSTQLDMTLEMMSDAIDETLDKDEAEEETEELTNQVLDEIGVDVASQLSSAPKGRIGATNKKVDNGQARPARNVAAPALEPSSAEVEDLERRLASLRRT

SEQ ID NO: 1179 - protein, 153 aa, Zea mays
  misc_feature (45)..(45): Xaa can be any naturally occurring amino acid
VLQGRAHWVGTDQDALALAVRDAPRYPAPAIKVTFQRPSPATLQXSFTGTLRSRVEGPGGASVLVALYESGLVTDCGRGENKGKSLFNDHVVRRLEKVAAVREGASPKKTVSGPVQFPLWDGFRAPKCGLVFFVQNAALQVLGVQHFDLPDNV

SEQ ID NO: 1180 - protein, 175 aa, Zea mays
MKIQCDACEGAAATVVCCADEAALCARCDVEIHAANKLASKHQRLPLEALSAKLPRCDVCQEKAAFIFCVEDRALFCQDCDEPIHVPGTLSGNHQRYLATGIRVGLASASACSDACDAHDSDHHAPPKATIEPPHAAVSAAVQQVPSPPQFLPQGWAVDELLQFSDYESSDKARR

SEQ ID NO: 1181 - protein, 259 aa, Zea mays
YCRERLQVLLRQELRLLGEDLGQISCDVDMKEHWDELFTGCFQRLDDEVSGQASRLVGAVQESRPVAAENVGSTAVVAVVCSSHVVVANCGDSRAVLCRGKEPVELSIDHKPDRKDERARIEALGGKVIQWNGYRVSGILAMSRSIGDRYLKPFVIPKPEVTVVPRAKDDDCLILASDGLWDVVSNEEACKAARRQIQLWHKNNGVTSSLCDEGDESNDPAAQAAADYLMRLALKKGTEDNITVIVVDLKPRKKAKSNS

SEQ ID NO: 1182 - protein, 593 aa, Zea mays
MSEQQQPLPQPRSSMREALEKEDKEKAAAAAAAKEKAAVPKNGNGNGGKNGGGAGSGNGGAPPQSGEETAREIQVVREAYRRETAAPAYVIPEEPPAVVELVGWYIYGFCSYFITHLLLPVLFPAIITQVAFPNSDFTPDPKYTLKGVTCSVHEMSMYQRLTKHSIVIDGSRMSPLGWSGLSWAIGILIVAPLLTQTAHHLDRGQYQSLILIAATSFGSFFCLLTGFFKTVWVFLFYILFIAGSIIVAEAVHTRNLGLMIRGLAAHDSGKHLVLRRRAAASQLSLYCTAIGGIGAALMAAFMYHMLRRTDQLTGLWVVSIFCGLIWFIGICHGLFTNRPSSSSPTTAFEPNFFTKLSYSMTLLRYPQAIGSLVAVFLSSFATMCIFTSGTLYAIGGVCIKPVLVLALWILYFLFPLISLPLLHPIQIIIRADAVRMQLLGFIICLFVSGAGFYFKSHRWRAAHIIVIALVQSTANGILYAFGRILLLDASPPGKEGAFSVWYAFVRVTGAMIGFAASSAGPGRAGGSFAAAFLGSFLGIIVLIFGNVSNIGALKAAGHLKGMDDEKRMGGLGMEKGEGMGSAVADSGESRGRV

SEQ ID NO: 1183 - protein, 372 aa, Zea mays
QPALPLRLLFLSLHSLLSAAPSSPASTMATAAAATASSSLLAPAASSTAPASSNALLFPSSVPSLRAYPRLLLAFRRPAAAAIADPQGAVLEEEAEVDQQGQYDDDDGYEGGRGPAFTAPTRPRTGKAALLLKRDRTRSKRFLEIQKLRESKKDYDVPTAISLMKQMSSAKFVESAEAHFRMNLDPKYNDQQLRATVNLPKGTGQSVKIAVLTQGEKIDEARAAGADIVGGEDLIEQIKGGFMEFDKLIASPDMMPKVAGLGKILGPRGLMPNPKAGTVSSNITQAIEEFKKGKVEYRVDKSGIVHIPFGKVDFPEEDLIANFMSVVRSVERNKPSGAKGIYWKTAYLCSSMGPSIKLNIKEMLDYGLESSD

SEQ ID NO: 1184 - protein, 443 aa, Zea mays
EALPHPDERVEYEFWTNSNDECGPKCDSQIDFVKSFKGAAQVLEKKGYTEFTPHYITWYCPEAFILSKQCKSQCINHGRYCAPDPEQDFSKGYDGKDVVVQNLRQVCVFKVAKEHKKPWLWWDYVTDFAIRCPMKEKKYTKECADGVIKSLGLDHKAIDKCIGDPDADEENPVLKAEQDAQIGKGSRGDVTILPTLVINNRQYRGKLDKGAVLKALCAGFKETTEPAVCLSEDIQTNECLENNGGCWQDKAANITACKDTFRGRVCECPIVKGVKFVGDGYSHCEASGSGRCEINNGGCWKDTKNGRTYSACNDDGCKCPDGFKGDGRHKCEDIDECKERTACQCKECKCKNTWGSYECGCSGGLLYMKEHDTCISKSGASEAGWGFLWVIFFGLVAAGIAGYAVYKYRIRRYMDSEIRAIMAQYMPLDNQGDVQSHSHHIEM

SEQ ID NO: 1185 - protein, 360 aa, Zea mays
GAGYEGKDVVVENLRQLCVHRVANETGRPWAWWDYVMDYKIRCSMKEKKYTKTCAEDVVTALGLDLKKVLECMGDPEADADNAVLSKEQEDQIGSGSRGDVTILPTLVINNVQYRGKLERTAVLKAVCAGFKEGTEPRVCLSHDIETNECLHRNGGCWRDEATNVTACQDTYRGRVCECPVVNGVRYEGDGYTDCKAIGPGRCALNNGGCWSATRGHQTFSACTETALTGCRCPPGFHGDGHKCEDLDECREKLACTCPDCQCKNTWGNYECKCKGNQLYIRGEDVCIANSMSKLGWFITIAAVACVLGVGVAGYVFYKYRLRSYMDSEIMSIMSQYMPLDSQNNENQPLRQHDSEALRH

SEQ ID NO: 1186 - protein, 75 aa, Zea mays
MAAAPADAKAEAAKMDLLEDDDEFEEFEIDQEWDDQEEGNEAVQQWEDDWDDDDVNDDFSLQLKEELDGSNGQKS

SEQ ID NO: 1187 - protein, 176 aa, Zea mays
  misc_feature (6)..(6): Xaa can be any naturally occurring amino acid
METFPXVKNILLLDSEGKRVAVKYYSDGWPTLSAKLAFEKSVFAKTQKANAGTDAEIVMFDGQIVVYKFIQDLHFFVTGGEEENELILASVLQGFSDAVERLLKNMVDKRTALENLDLILLCLDEIVDGGIVLETEGREIAEKVSGHGSEGASSAEQTLVNALTQAREHLAKSLLM

SEQ ID NO: 1188 - protein, 230 aa, Zea mays
MTTAARPTWAPAKGGNEQGGTRIFGPSQKYSSRDLAAHTSLKLRKDGQQTQEELQKRNLREELEERERKHYSSKDKSYAEERDRRKSSSQLLLEGSKREAEDKIVPREIDADDSDVEPKSDDESDEDGDDDDTEALMAELERIKKERAEEKLRKERQQAEEEAKMKEAELMRGNPLININNPGSFSVKRRWDDDVVFKNQARGETKTPKRFINDTIRSDFHRKFLHRYMK

SEQ ID NO: 1189 - protein, 207 aa, Zea mays
MAASSCHGQLLLFLLVAVASACLGSAAAHQAGSGEGYTIAGRVKIDGTSVKGFGLATKTSNTKVILNGGQRVTFARPDGYFAFHNVPAGTHLIEVSSIGYFFSPVRVDISARNPGYIQAALTETRRVLNELVLEPLKEEQYYEVREPFSVMSLLKSPMGLMVGFMVLMVFVMPKMMENIDPEEMKQAQEQMRNNPVSLSGLLARAQG

SEQ ID NO: 1190 - protein, 553 aa, Zea mays
MDEDFEMPPAGADEMMGDDEMGDFGGDEGPVMKVGEEKEVGKEGLKKKLLKEGEGWETPEVGDEVEVHYTGTLLDGTKFDSSRDRGEPFKFKLGQGQVIKGWDQGIKTMKKGENAIFTIPPELAYGASGSPPTIPPNATLQFDVELLSWTSVKDICKDGGIFKKILKEGEKWENPKDPDEVLVKYEARLEDGTVVSKSEGVEFTVKDGYFCPALAKAVKTMKKAEKVLLTVKPQYGFGEKGRPAAGEEGAVPPNASLLIDLELISWKTVTEIGDDKKILKKVLKEGEGYERPNEGAVVEVKIIGKLQDGAVFTKKGHDEEPFKFKTDEEEVIAGLDRAVLNMKKGEVALVTIPPEYAFGSTESKQDLAVVPPNSTVIYEVELISFVKDKESWDLNNEEKIEAAGKKKEEGNALFKSGKYARASKRYEKAAKYIEYDTSFSEDEKKQSKQLKISCNLNNAACKLKLKDYKEAAKLCTKVLELDSQNVKALYRRVQAYIQLADLELAEADIKKALEIDPDNRDVKLEYKILKEKIKEYNKKDAKFYSNMFAKMTK

SEQ ID NO: 1191 - protein, 287 aa, Zea mays
EEAVKAMNLFEGAQEHNRVSKRSLKNWVVNAFRERKALALTLNDTKTAVNKLNQMVNVVVGIIVFVLWLLILGIATTHFFVFLSSQLLLAVFVFGNTLKTVFEAIVFLFVMHPFDVGDRCEIEGVQAVVEEMNIMTTVFLRYDNLKIYYPNSVLATKPIMNFYRSPDMGEAIDFSIHVSTPVEKLALMKERILRYIDNKKEHWYPGAMVVLRDVDDTNKLKVSIWLRHTLNFQDMGMRFVRRELVLQEMIKVLKDLEIEYRMLPLDVNVRNAPPIQSTRMPTTWSYS

SEQ ID NO: 1192 - protein, 246 aa, Zea mays
MGSSEADEDQLLKSFLAEVSEAERDNEVLRILGCFKLNPFEHLKLSFDSSPDEVKKQYRKLSLLVHPDKCKHPQAQEAFAALAKAQQLLLDPQERGYILDQVTAAKEELRAKRKKELKKDSASKIKSLVDEGKYEEQFERSDGFQQQLIIKVREILTDKEWRRRKMQMRISEEEGRLKKDEEETKEMWKRKREHEEKWEETRDKRVSSWRDFMKTGKKGRKGEIKPPKLKTEDPNKSYVQRPVKRN

SEQ ID NO: 1193 - protein, 62 aa, Zea mays
SGSCCSAVHAIGKQSPRCLCAVMLSNTARSAGIKAEVAITIPKRCNLADRPVGYKCGDYTLP

SEQ ID NO: 1194 - protein, 161 aa, Zea mays
MAASSLCHGHLLLFLLVSVTSACLGTAAAHQAGSGEGYTIAGRVKIDGVSAKGYGLPAKTSNTKVILNGGQRVTFARPDGYFAFHNMPAGTHLIEVSSIGYFFSPVRVDISARNPGYIQAALTETRRVLNELVLEPLKEEQYYEVREPFSVMSLLKSPHGV

SEQ ID NO: 1195 - protein, 442 aa, Zea mays
NLHAPAAKLPPPCLLPRRPALPPSAPAMGTGRRGGGGGGVFHRLLALSSLLLLASGEVVFEERFEDGWETRWVESDWKRSEGKAGRFKHTAGRYSADPDDKGIQTTIDARHFAISAKFPEFSNKNRTLVVQYSIKFEQDIECGGGYIKLMSGYVNQKKFSGDTPYSLMFGPDICGTQTKKLHLILSYQGQNYPIKKDLECETDKLTHVYTFILRPDASYSLLVDNRERESGSMYTDWDILPPRKIKDVHAKRPKDWDDREYIEDPDEVKPEGYDSIPKQIPDPKDKKPDTWDEDEDGIWKPRMVSNPAYKGPWKRKRIKNPNYKGKWKTPWIDNPEFEDDPDLYVLKPLKYIGIEVWQVKAGSVFDNILICDDPEYARKVVEETWGANREAEKEAFEEAEKERKAREDREGQKAKDDGGRHRIHRRHKKHYRDHWDDYHDEL

SEQ ID NO: 1196 - protein, 111 aa, Zea mays
MARQLVVLALLFVIAGVAHGAGECGRASADRVALRMAPCISAADDPQSTPTSSCCSAVHTIGQSPSCLCAVMLSGTARAAGIKPEVAITIPKRCNMADRPVGYKCGDYTLP

SEQ ID NO: 1197 - protein, 208 aa, Zea mays
  misc_feature (151)..(151): Xaa can be any naturally occurring amino acid
MAASSLCHGHLLLFLLVSVTSACLGTAAAHQAGSGEGYTIAGRVKIDGMSEKGYGLPAKTSNTKVILNGGQRVTFARPDGYFAFHNVPAGTHLIEVSSIGYFFSPVRVDISARNPGYIQAALTETRRVLNELVLEPLKEEQYYEVREPFSXMSLLKSPMGLMVGFMVLMVFVMPKMMENIDPEEMKQAQEQMRNNPVSFSGLLARAQG

SEQ ID NO: 1198 - protein, 228 aa, Zea mays
MAPAESGEKATSFAMACSLLSRYVRQNGAAAADLGLAIRAESDAKRTSTDMEKGETGKETMDLFPQIAGFGSEAATKEAPDAREPEKRQLTIFYGGKVLVFDDFPAEKAKDLMQMASKGSPVAQNPGLLPPSTAATVTDSTKIAAVPAAPIAVANAQKSAADIPQAPKASLRRFLEKRKDRLTAKAPYPGSPSDVTPVKKEMSDGQPWLGLGPQIANPDLSLSKEASQ

SEQ ID NO: 1199 - protein, 73 aa, Zea mays
MARQLVVLALLFVIAGVAHGAGECGRASADRVALRMAPCISAADDPQSTPTSSCCSAVHTIGQSPSCLCAVML

SEQ ID NO: 1200 - protein, 538 aa, Zea mays
SSGKAPLSEVPESSRTNVVGTSSVVRSLFSASSSSVSSSPEKQPTENEKMVNEMLHEDASAFAGRSDSASTAEEEFQNKVRETMEKAFWDMVTNSMRGERPDYSQLINLVKEVRDSLHDLAPKEWKEKILENIDLEILSQVLGSGSQDAQYLGQILEYSLDMVRKLSAAAKEDEMKKNHDKLLSELSTNSEVNGDGINSFVIAVIKGLRFILEEIKELKAEVSKARIQMMQQIIKESAGVEYLQKAFADRYGPPETAPASLPLTLQWILTSKNIAEEEWSEHSDCLSVMPAAGQAPALVPVLRSGHGAPVGQPSPSAGDTSGQPECKGEKLDKLIRIGLLQLISSVEGLQLQSTPESFQINLLRLRAVQSQFQQVIVIATSMLVLRQVLMSENSRATPLELENAISELVKALADILHSSPDSGTEEIVQAMVNASASVGSPSEEKVQARMQMITRVFLKSLQPGDVVFKKVSRAVYCAFRGIILGGSGPKGQKLADAALRRIGATNVVDRVLKAAEVLIKVATVSEKVHGPWYKALIV

SEQ ID NO: 1201 - protein, 420 aa, Zea mays
MGRLRDGRAFLHRALVLSSLLLLASGEIFFEERFDDGWDSRWVKSDWKKSQGQAGTFRHTAGTYSGDPDDKGIQTTGDAKHFAISAKFPQFSNKDRTLVIQYSLKIEQDIECGGAYIKLMSGYLNQKKFGGDTPYSFMFGPDICGDQKKKLHLILSYQGQNYPIKKELKCETDKLTHFYTFILRPDATYSILIDNREREFGSMYTDWDILPPRKIKDVNAKKPKDWDDREYIEDPDQVKPEGYDSIPKEIPDPKDKKPESWDDDDDGTWKPRMIPNPEYKGPWKRKKIKNPNYKGKWKTPWIVNPEFEDDPDLYVLKPLQYVGIEVWQVKAGSVFDNILICDDPDYARHVVDETFAANKEAEKEAFEGAERKRKAREEEEARRAREEGERRRRERDRDRGRDRYKDRYKRHRHYDYHDEL

SEQ ID NO: 1202 - protein, 231 aa, Zea mays
MGSSEADEDQLLKSFLAEVSEAERDNEVLRILGCFKLNPFEHLKLSFDSSPDEVKKQYRKLSLLVHPDKCKHPQAQEAFAALAKAQQLLLDPQERGYILDQVTAAKEELRAKRKKELKKDSASKIKSLVDEGKYEEQFERSDGFQQQLIIKVREILTDKEWRRRKMQMRISEEEGRLKKDEEETKEMWKRKREHEEKWEETRDKRVSSWRDFMKTGKKVRMCIWQVVSSYA

SEQ ID NO: 1203 - protein, 495 aa, Zea mays
MARKMLIDGEVAAVADGGHYDYDLFVIGAGSGGVRGSRTAASFGAKVAICELPFHPISSEWLGGHGGTCVIRGCVPKKILVYGASFRGEFEDSKNFGWEINGDINFNWKTLLENKTKEIVRLNGVYQRILTSAGVTMIEGAGSLVDAHTVEVSQPDGSKQRYTAKHILIATGSRAQRVNIPGKDLAITSDEALSLEELPKRAVILGGGYIAVEFASIWRGMGAEVDLFYRRDLPLRGFDDEMRAIVASNLEGRGIKLHPGTNLSELSKTADGIKVVTDKGEELIADVVLFATGRTPNSQRLNLQAAGVEIDRVGAIKVDEYSRTSAPSVWAVGDVTNRINLTPVALMEATCFAKTVFGGQQVKPDHRDVPCAVFSIPPLSVVGLSEEQALEEANGDILVFISSFNPMKNSISKRQEKTIMKLVVDAETDKVLGASMCGPDAPEIIQGIAIAVKCGATKADFDSTVGIHPSAAEEFVTMRTVTRRLSPTSKPKTNL

SEQ ID NO: 1204 - protein, 346 aa, Medicago sativa
  misc_feature (275)..(275): Xaa can be any naturally occurring amino acid
MDEDFDIPAVDSMNDDFDFAGAGDNPILKVGEEKEIGKQGLKKKLLKEGEGWDTPDVGDEVHVHYTGTLLDGTKFDSSRDRGTTFNFTLGQGQVIKGWDEGIKTMKKGENALFTIPPELAYGESGSPPTIPPNATLQFDVELLSWTSVKDICKDGGLFKKIVKEGEKWENPKDLDEVLVKYEARLDDGTLVAKSDGVEFTVKEGYFCPALPKAVKTMKKGEKVILTVKPQYGFDEKGKPAHGDEGAVPPNATLEITLELVSWKTVSEVTDDKKVXKKIVKEGEGYERPNDGAVVKLKLIGKLQDGTVFLKKGHGDDEAELFEFTTDEEQVIDGLDRAVMTMKKGEV

SEQ ID NO: 1205 - protein, 274 aa, Medicago sativa
MSFQDIEAGRPFGSRRGGPINGKQDPTQAVAAGIFQINTAVSTFQRLVNTLGTPKDTPELREKLHKTRQHIGQLVKDTSAKLKQASDIDHHADVNASKKIADAKLAKDFQAVLKEFQKAQRLSAERETAYTPFVPQAVLPSSYTASEMDIGTDKTPEQRALLVESRRQEVLFLDNEIAFNEAIIEEREQGIQEIQQQIGEVNEIFKDLAVLVHEQGTMIDDIGSNIENSHAATAQAKSQLAKASKTQRSNSSLACLLLVIFGIVLLILIIVLAA

SEQ ID NO: 1206 - protein, 498 aa, Medicago sativa
MARKMLKDGEPDLNKGAEEGTNFDFDLFIIGAGSGGVRAARFSSNHGAKVAICELPFHPISSETIGGVGGTCVIRGCVPKKILVYGASYGGDLEDARNFGWELSENIDFNWKKLLQKKTDEINRLNGIYKRLLSNAGVKLFEGEGKIAGPHEVEVTQLDGTKLSYSAKHILIATGSRAQRPNIPGQELGITSDEALSLEEFPKRVVILGGGYIAVEFASIWRGMGANVNLVFRKELPLRGFDDEMRAVVARNLEGRGINLHPRTNLTQLIKTEDGIKVTTDHGEELIADVVLFATGRAPNSKRLNLEKAGVEVDKTGAIVVNEYSCTNIPSIWAVGDVTNRMNLTPVALMEASHFANTVFGGKTQKPDYRDIPYAVFSIPPLSVVGLSEEEAVEQTNGDLLVFTSTFNPMKNTISGRQEKTVMKIVVDAQTDKVLGASMCGPDAPEIVQGIAIALKCGATKAQFDSTVGIHPSAAEEFVTMRSVTRRVTGSAKPKTNL

SEQ ID NO: 1207 - protein, 250 aa, Medicago sativa
MGESNSSTIIEDDLLLKNFFAEVSEVERDNEVLRILGCFKLNPFEHLNLSFDSSIDEVKKQYRKISLMVHPDKCKHPQAKEAFGALAKAQQLLLDPNERDYLLSQVNSAKEELRVKRKKHLKKDTASKMKSLVDEGKYDKQYEQSEEFKQELKLKVRELLTEKEWRRRKMQMRISEEEGRLKKDEEEQKEIWKRKREHEEEWEGTREKRVSSWRDFMKGGKKNKKGEIRPPKLKTEDPNKSYVQRPVKRG

SEQ ID NO: 1208 - protein, 544 aa, Medicago sativa
MNDDFEIPQAEEMNEDFDLPEEKVGDEREVGDRGLKKKLLKLGEGWDTPESGDEVQVHYTGTLLDGTKFDSSRDRDSPFSFTLGQGQVIQGWDEGIKTMKKGENALFTIPPELAYGESGSPPTIPPNATLQFDVEMLSWTSVKDICKDGGIFKRILKEGEKWENPKDPDEVLVNYEVRLEDGKAVAKSDGVEFTVSEGHYCPAFSKAVKAMKKGEKVILLVKPQYGFGEKGKPAHGDEGAVPPNASLQITLELVSWKTVSDVTSDKKVIKKILKEGEGYERPNEGAIVKLKLIGKLQDGTVFFEKGHDEEEKLFEFKTDEEQVIDGLDKAVLTMKKGEVALLIIAPEYAFDSSQSQQELAVPPNSTVYYEVELVSYEKEKESWDMNTQEKIEAAGKKKEEGNVLFKAGKYERASKRYDKAAKYIEYDSSFSEEEKKLSKTLKIASYLNNAACKLKLKEYKDAEKLCTKVLDIESTNVKALYRRAQASMQLTDLDLAEIDIKKALEVDPDNREVKLEYKNLKQMVKEYNNKQAKFYGNMFGLRKA

SEQ ID NO: 1209 - protein, 199 aa, Medicago sativa
MWNRMNFQEEAVQIMNSDFKDLSEAASKLANHAIKLAGVGGFGASFFGFFAAVAAIYLLVLDRTNWKTNILTSLLIPYIFFSLPSFVFAVFRGEIGKWIALVAVVLRLFIPKHFPDWLELPGALILLIVVSPDLVASTFRNDLVGVIVCLVIACYLLQEHIRASGGFRNSFTRANGVSNSIGIILLLVYPIWALLTILF

SEQ ID NO: 1210 - protein, 445 aa, Medicago sativa
  misc_feature (18)..(18): Xaa can be any naturally occurring amino acid
  misc_feature (444)..(444): Xaa can be any naturally occurring amino acid
IRHQAGCFYYLLAARYHXPEKTWIGESMKDFLQQSLWTRYVTTIYWSITTLTTVGYGDLHPVNEREMIFVIFYMLFNLGLTAYLIGNMTNLVVHGTSRTRKFRDTIQAASSFAHRNQLPPRLQDQMLAHLCLKFRTDSEGLQQQETLESLPKAIRSSISHYLFYSLMDKVYLFKGVSNDLLFQLVSEMKPEYFPPKEDVILQNEAPTDFYILVTGAVDLVVLKGGVEQIVGEAKTGELCGEIGVLCYKPQHFTVRTKRLSQLLRLNRTTFLNIVQANVGDGTIIMNNLLQHLKELNDPIMEGVLVETENMLARGRMDLPVSLCFAAERGDDLLLQQLLKRGLEPNESDNNGRTALHIAACKGKENCVLLLLDYGANPNIRDSDGNVALWEAILGGHESVTKLLAENGATLQIGDVGQYACTAVEQNNFNLLQDIMRYGGDITLXK

SEQ ID NO: 1211 - protein, 137 aa, Medicago sativa
MSFQDLESGRRNLINGKQNPTQAVASGVFQINTAVSTFQRLVNTLGTPKDTPELREKLHKTRLHIGQLVKDTSDKLKQASEIDHHADVNATKKIADAKLAKDFQAVLKEFQKAQRLAAERETAYTPFVPHEDQPSRQ

SEQ ID NO: 1212 - protein, 404 aa, Cucumis melo
RKMLIDGEQCHQAEAEEHYDFDLFVIGAGSGGVRASRFSASHGAKVGICELPFDPISSEVVGGIGGTCVIRGCVPKKILVYGASFGPELQDARSFGWDVNEKVDFDWKKLLQKKTDEIVRLNGIYKRLLTNSGVKMYEGEGKIVGPHEVEVTQLDGTKICYSAKHILIATGSRAVIPDIPGKEFGITSDEALSLEELPKRVVVLGGGYIAVEFASIWNGMGAKVDLCFRRELPLRGFDDEMRAVVARNLEARGINMHPRTNLTELIKTGNGIKVITDHGEELLADAVLFATGRAPNSKRLNLNAVGVEVDKHGAVKVDEYSRTTVPSIWAIGDVTNRMNLTPVALMEGSYFANTVFGGEPTKPDYNFVPYAVFCIPPLSVVGQSEEEAVEKAKGDILVYTSSFN

SEQ ID NO: 1213 - protein, 229 aa, Cucumis melo
MTTAARPTWAPAKGGNEQGGTRIFGPSQKYSSRDIASHTTLKPRKEGQDTHDELQRRNLRDELEDRERRHFSSKNKSYDDRDHRKGSQLLLEGGKRDIEDRIIPRSLDADDSDVDVKSDDESDDDDDDDEDDTEALLAELEQIKKERAEEKLRKERQEREEELKVKEAELLRGNPLLNEQPSSFSVKRRWDDDVVFKNQARGESKTPKRFINDTIRNDFHRKFLQKYMK

SEQ ID NO: 1214 - protein, 274 aa, Cucumis melo
  misc_feature (219)..(219): Xaa can be any naturally occurring amino acid
MSFQDIEAGRPFASSRRDLINGKQDPTQAVASGIFQINTAVATFQRLVNTLGTPKDTPELREKLHKTRLHIGQLVKDTSAKLKQASDIDHHAEVNASKKIADAKLAKDFQAVLKEFQKAQRLAAERETAYSPFVPQTNLPSSYTAGEADASSEKNLEQRALLVESRRQEVLLLDNEIAFNEAIIEEREQGIHEIQQQIGEVNEIFKDLAVLVHEQGAMXDDIGSNIEGAHAATSQGTTQLVKASKTQRSNSSLACLLLVIFGIILLIVIIIVVA

SEQ ID NO: 1215 - protein, 256 aa, Cucumis melo
  misc_feature (2)..(2): Xaa can be any naturally occurring amino acid
  misc_feature (119)..(119): Xaa can be any naturally occurring amino acid
MXEFTPNTNLHFLPSIKLFLSLLLINSIFTFHTALSEIFFEERFEDGWKSRWVLSDWKRSEGKAGTFKHTAGKWAGDPDDKGIQTYNDAKHFAISAKIPEFSNENRTLVVQYSIKFEQXIECGGGYLKLHSGYVNQKKYGGDTPYSMMFGPDLCGTQTKKLHAILSFQGQNYPIKKDLQCETDKLTHFYTFILRPDASYSILVDNRERDSGSMYSDWDILPPRKIKDVKAKKPADWDDREYIEDPNDVKPEGYDSI

SEQ ID NO: 1216 - protein, 142 aa, Nicotiana benthamiana
VYTPFVPQAVLPSSYTASEIDVSTEKSPEQRTLLVESRRQEVLLLDSEIAFNEAIIEEREQGIQEIQQQIGEVNEIFKDLAVLVHEQGAMIDDIGSNVENAHAATAQGRSLLAKAAKTQRSNSSLTCLLLVIFGIVLLIVII

SEQ ID NO: 1217 - protein, 134 aa, Avena sativa
ARGDEDKIVPREIDADDSDVEPRSDDESDDDDDDDDTEALMAELERIKKERAEDKLRKDRQQAEEEAKMKEAELMRGNPLINMNNSGSFNVKRRWDDDVVFKNQARGETKTPKRFINDTIRSDFHRKFLHRYMK

SEQ ID NO: 1218 - protein, 140 aa, Avena sativa
MLSSVKPGMSKEVANFSTSPLRFSMSLFEDQFERSDEFHKQLIIKVREILTDKEWRRRKMQMRISEEEGRLKKDEEETKEMWKRKREHEEKWEETRDKRVSSWRDFMKTGKKARKGELKPPRLKTEDPNKSYVQRPVKRG

SEQ ID NO: 1219 - protein, 247 aa, Allium cepa
MSFQDLEAGRPLKGRINGKQDPTQAVASGLFQISTAVATFQRLVNTLGTPKDTPILREKLRKTRLHITQLVKDTSAKLKQASETDHHIEVSASKKIADAKLAKDFEAVLKEFQKAQRLAAERETAYAPFVPQAAQPNSNTSNEADVSYDKSQEQRQLLDSRRQEVLLLDNEIVFNEAIIEEREQGIQEIQNQIGEVNEIFKDLAVLVHDQGAMIDDIDTHIESSLAATVQAKSQLVKAAKTQKSIHL

SEQ ID NO: 1220 - protein, 203 aa, Allium cepa
MTTAARPTWAPAKGGQEQGGTRIFGPSQKYSSRDLAAHTTLKPRKEGQDTQEEVQRRNLREELEEREYRHFSSKDKSFTEDRDRRKGHLLLEGSKRDVEDRIVPRNVDADDSDVDVKSDDDSDEDDDDDEDDTEAIMAELERIRKERAEEKLRKERQQQEEDLKVKEAELMRGNPLININNAASFNVKRRWDDDVVFKNKTRG

SEQ ID NO: 1221 - protein, 296 aa, Allium cepa
  misc_feature (185)..(185): Xaa can be any naturally occurring amino acid
MKKGENAVFTIPPELAYGESGSPPTIPPNATLQFDVELLSWSSVKDICKDGGIIKKILKEGENWQNPKDRDEVFVKYEARLEDGTVVSKSVGVEFTVKDGLFCPALAKAVKTMKKGEKVILTVKPQYGLGEMGRPSSGEEGAVPPNATLNIELELVSWKTVSEIGDDKKILKKILKEGEGYDKPXEGAVVKVKLSGKLRDGTIFVKKGNDEEPFEWKTDEEQVIEGLDKAVMSMKKGEVAFLTIPPEHAFSSTESKQDLAVVPPNSIVTYEIELVSFEKEKEPWDMNTTEKIEACW

SEQ ID NO: 1222 - protein, 351 aa, Carica papaya
VILTVKPQYGFGEKGKPASGDEGAVPPNATLQITLELVSWKTVSEVTDDKKVIKKILKEGEGYERPNEGAVVKVKLMGKLQDGTVFLKKGHDEDELFEFKTEEEQVIDGLDRAVVTMKKGEVALLTIAPEYAFGSSESKQELAVVPPNSTINYEVELVSFVKDKESWDMNTQEKIEAVGKKKEEGNVLFKAGKYARASKRYEKAVKYIEYDTSFGEEEKKQSKALKVACNLNNAACKLKLKDYKQAEKLCTKVLELESRNVKALYRRAQANIQLADLDLAELDIKKALEIDPDNREVKLEYRTLKEKMKEYNKKEAKFYGNMFAKMNKLESLESNKTTSKEAKPMSIDSKA

SEQ ID NO: 1223 - protein, 275 aa, Carica papaya
SSAINRVDMDTDCLDYEILWEDLTIGEQIGQGSCGTVYHGLWFGSDVAVKVFSKQEYSDDVIDSFRQEVLLMKRLRHPNVLLFMGAVTSPEHLCIVTEFLPRGSLFRLLHRNTPKLDWRRRIHIALDIARGVNYLHHCNPPIIHRDLKSSNLLVDKNWTVKVGDFGLSRLKHETYLTTKTGKGTPQWMAPEVLRNEPSDEKSDVYSYGVILWELATEKIPWDNLNSMQVIGAVGFMNQRLEIPKEVDSQWASIIESCWHSDPQFRPTFQELLEKL

SEQ ID NO: 1224 - protein, 346 aa, Carica papaya
ATVTRLHPSSQGLKEFINEVNTLASLQHPNLCKLLGYHARDSSEQRMLIYERLFHGSLDRLLYGRSDGPLVDWNTRMKIALCAAQGLTFLHEEGPFQAMYNEFSTANIQIDKDFSAKLSGYGCVGHIPEAEISNSSVALANLSVETLERGLLTPKSNVWSFGIVLLELLTGKKNLDSRHPKEEWNLVKWSKPFLADDCRLSLIMDPLLKGRFPAKAARAVADIAQRCLQKDPSERPTMRTIVERLKFIQDMKYSCRFPLQEPALISGKQMSRSPSLNGIVTPAPRLSFSPSPPSRSRPSVSPPRPHGLPLSLPPRACSSVLSLEELERQESQKSSSTVRRPSVEGF

SEQ ID NO: 1225 - protein, 331 aa, Carica papaya
KNENEKIEELVREYSASTDLVSLDWKKMKIPPVLSSTEHAWLFKLMQPMKALLQVKEELEKNLGHEPTEGELAKATNMNIVQVKKQMEIGRAARNKLIKHNLRLVLFVINRYFQDFANGSRFQDLCQAGVKGLITAIDRFEPKRRFRLSTYSLFWIRHAIIRSMTVSSFTRVSFGLESVRVEIQKAKLELLFELGRLPTDDEIIKKVGISPERYHEVMRASKPVFSLHSRHAVTQEEFINGITDVDGVGSDSQRQSALLRLALDDVLDSLKPKESLVIRQRYGLDGRGDRTLGEIAGNLNISREMVRKHEVKAFMKLKHPTRVDYLCRYIV

SEQ ID NO: 1226 - protein, 265 aa, Carica papaya
MARKMLIDGELNKPSEEAHYDFDLFVIGAGSGGVRAARFSANFGAKVGICELPFHPISSEVIGGVGGTCVIRGCVPKKILVYGASFRGEIEDARNYGWEVNENVDFNWKKLLQKKTDEIVRLNGIYKRLLSNAGVKLYEGEGKIVGPTEVEVTQLDGTKLCYSAKHILIATGSRAQRPPIPGHELAITSDEALSLDELPKRAVVLGGGYIAVEFASIWRGFGSNVDIFFRKELPLRGFDDEMRAMVARNLEGRGINVHPRTSLKE

SEQ ID NO: 1227 - protein, 332 aa, Carica papaya
KEGEGWETPSAGDEVEVHYTGTLLDGTKFDSSRDRGAPFKFKLGQGQVIKGWDEGIKTMKKGEKAIFTIPPELAYGDSGSPPSIPPKATLQFDVELLSWTNVKDICKDGGIFKKILVEGEKWDNPKDLDEVLVRYEARLEDGTLVSKSDGVEFTVAEGYFCPALEKAVKTMKKGEKVLLTVKPQYAFGENGRPASGGEGAVPPNANLEITLELVSWKTVTDVTKDKKVLKKVLKEGEGYERPNEGAVVQVKLTGKLHDGTVFVKKGYDEEPPFEFKIDEEQVIDGLDRAVRNMKKGEVALITIHPEHAFGATGSQQIWLLSLPTLRYIMKLK

SEQ ID NO: 1228 - protein, 535 aa, Prunus persica
MDHPISDDPKSPLLPLHHDHDHDHDPIQRSQSFLSGLKSILTLKTLSVLLGPLLCTIICLCVKLDGPVASRNMLAVLVWVFAWWLTEAVPMPITSMSPLFLFPLFGIASADDVAHSYMDDVIALVLGSFILALAVEHYNIHRRLALNITMLFCGDPLNPPLLLLGICATTAFVSMWMHNVAAAVIMMPVATGILQRFPVGPDQSVAVSKYCRAVVLGVIYSTAIGGMSTLTGTGVNLILVGMWKSYFPDAEPISFSTWFFFGFPLALLMFLALWVILCCLYCSRNSSQALSGYLDKAHLKRELEMLGPMVFAEKMILAVFSMLIVLWMTRSITDDIPGWGALFKGRAGDGTVSVMMATLLFIIPNKKQKGEKLMDWNKCKKLPWNIILLLGAGFAIADGVRTSGLADILSKALDFLEAVPYFAIAPAVCLISSTITEFTSNNSTTTLVVPLLIQIAKIMHVNPLLLMVPGAIGAQFSFLLPTGTPSNVVGFTTGHIEIQDMIKTGLPLKIAGIAVLSLLMPTLGAYVFGTNGPVQ

SEQ ID NO: 1229 - protein, 464 aa, Prunus persica
  misc_feature (425)..(425): Xaa can be any naturally occurring amino acid
ALFTIPPELAYGETGSPPTIPPKATLQFDVELLSWTSVNDISKDGGIIKKILKEGEKWENPKDLDEVIVNFEARLDDGKVVEKSDRVEFTVKDGYFCPALSKAVKTMKKGEKVLLTVKPQYGFGDKGKPASGYVGAVPPNATLHITLELVSWKTVSEVTDDKKVIKKILKEGEGFERPNEGAVVKLKLIGKLQDGTEFLKKGHAEGEELFEFKTDEEEVIDGLDRAVLTMKKGEVALLTLAPEYAFGSSESPQELAVVPPNSTVYYEVELVSFEKDKESWDMNTEEKIEAAGKKKEEGNALFKAGKYARASKRYEKAVKYIDYDTSFSEEDKKQSKVLKVACNLNNAACKLKLKDYKQAEKLCSKVLEIEGRNVKALYRRAQAYIQLADLDLAELDIKKALEIDPNNRDVKLEYKTLKEKMKEFXKKEAKFYGNMFAKLTKSDSPDSNKTAAKDAEPMSVDSKA

SEQ ID NO: 1230 - protein, 189 aa, Prunus persica
MTTAARPTWAPAKGGNEQGGTRIFGPSQKYSSRDMAAHTTLKPRKEGQDTQDELQKKNLREELEERERKHYSSKDKSYSYDRDRRRGSQLLLEGGRRDTEIVPRNVDADDSDVEVKSDDESSEDDDDDDEEALMAELEQIRKEKAEEKLRKERQEREEELKVKEAELLRGNPLLNGATATSFSVKEDGR

SEQ ID NO: 1231 - protein, 496 aa, Prunus persica
MSRKMLIDGEVSQPNQGEVHYDFDLFVIGAGSGGVRASRFSANFGAKVGICELPFHPISSEVVGGVGGTCVIRGCVPKKILVYGASFGGEIEDARNYGWEVNEKVDFNWKKLLHKKTEEIIRLNGIYKRLLSNAGVKLFEGEGKIVGPNEVEVTQLDGTKLSYSAKHILIATGSRAQRPAIPGQELGISSDEALSLEELPKRVVVLGGGYIAVEFASIWRGMGVSVDLFFRKELPLRGFDDEMRAAVARNLEGRGIDLHPQTNLTELIKTEDGIKVSTDHGEELIADVVLFATGRAPNTKRLNLEAVGVELDKTGAVKVDEYSRTNIPSIWAVGDVTNRANLTPVALMEGTCFAKTVFGDQPSKPDHRDIPCAVFCIPPLSVVGLSEEQAIEQAKGDILVFTSTFTPMKNTVSGRQEKTIMKLLVDAETDKVIGASMCGPDAPEIVQGIAIALKCGATKAQFDSTVGIHPSAAEEFVTMRSVTRRIAAGSKPKTNL

SEQ ID NO: 1232 - protein, 274 aa, Prunus persica
MSFRDLEAGRGLGFSRRDIVNGKQDPTQAVASGIFQINTAVSTFQRLVNTIGTPKDTPELREKLHKTRLHIGQLVKNTSEKLKQVSERDHHTEVNASKKITDAKLAKDFQAVLREFQKAQRLAAERETAYAPFVPQAVLPSSYTASEIDISSDKSPEQRALLVESRRQEVVLLDNEISFNEAIIEEREQGIQEIQQQIGEVNEIFKDLAILVHEQGTMIDDIGSNIEGAHAATGQAKSQLVKASKTQRSNSSLTCLLLVIFGIVLLIVIVVLAA

SEQ ID NO: 1233 - protein, 313 aa, Arachis hypogaea
DLVSLDWKKMKIPPVLPSSEHTWLFKLMQPMKALLQVKEDLQKELGKKPTEAELADATNMNVSQVKKTIEVGRAARNKLIKHNLRLVLFVINKYFSDFGNSPRFQDLCQAGVKGLITSIDRFEPNRRFRLSTYGLFWIRHSIIRSMTLSSFTRVPFGLESVRADIQRAKLELTFELQRQPTDEEIMERAQISPERYYDVMKASKSILSLNARHSTTQEEFINGITDDDGVNGDNRRQHALLRLALDDVLDSLKPKESLVIRQRFGLDGKGDRTLGEIAGNLNISREMVRKHEVKALMKLKHPARLDYLRRYVV

SEQ ID NO: 1234 - protein, 272 aa, Arachis hypogaea
MSFQDIEAGRPFASRRGHINGKQDPTQAVAAGIFQINTAVSTFQRLVNTLGTPKDTPELREKLHKTRLHIGQLVKDTSAKLKQASEIDHQSNINANKKIADAKLAKDFQAVLKEFQKAQRLAAERETAYTPFVPQAAPSSYTPNESDAHSGKTPEQRALLVESRRQEVLFLDNEIAFNEAIIEEREQGIQEIQQQIGEVNEIFKDLAVLVHEQGAMIDDIGSNIEHSHATTAQARSQLAKASKTQRSNSSLTCLLLVIFGIVLLIVIVVLAA

SEQ ID NO: 1235 - protein, 273 aa, Capsicum annuum
MSFQDLEAGRPLGPRKGYLNGKQDPTQAVASGIFQINTAVSTFQRLVNTLGTPKDTPELREKLHKTRVHIGQLVKDTSAKLKQASETDHRVEVSASKKITDAKLAKDFQAVLKEFQKAQRLAAERETAYTPFVAQAVLPSSYKASEIDVSTEKSQEQRALLVESRRQEVLLLDNEIAFNEAIIEEREQGIQEIQQQIGEVNEIFKDLAVLVHEQGAMIDDIGSNVENAHAATAQGRAQLAKAAKTQRSNSSLTCLLLVIFGIVLLIVIIVLAA

SEQ ID NO: 1236 - protein, 217 aa, Capsicum annuum
MKDGFFFRFVTRSKRFLEIQKLREIKKEYDLKTAIQLLKQTASSKFVETAEAHFRLNIDPKYNDQQLRATVNLPKGTGQTVKVAVLTQGEKFDEAKNAGADIVGGEDLIEQIKGGFMEFDKLIATPDMMSKVAAVGRILGPRGLMPNPKAGTVTSNIPQAIEEFKKGKVEYRADKTGIVHLPFGKANFSEEDLIINFIAAVKSVEANKPSGAKGVYW

SEQ ID NO: 1237 - protein, 342 aa, Capsicum annuum
MEEVSNKQIILKNYVSGFPKESDMELKINSIKLKVAENSNSVLVKNIYLSCDPYMRPRMTKTEGSYTESFTPGSLIVGLGVAKVVDSAHPNFKKDDLVWGMTGWEEYSIITAPETLFKIHNTDVPLSYYTGILGMPGITAYGGFYELCSPKKGETVYVSAASGAVGQLVGQFAKLCGCYVVGSAGSKEKVELLKNKFGFDDAFNYKEEQDLTAALKRYFPDGIDIYFENVGGKMLDAVLLNMRIHGRIAVCGLISQYNLEQNEGVHNLFCLISKRLRMQGFLAFDYYPLYHKFVDMVTPHIKEGKVKYVEDIAEGIESAPGALVGLFSGRNVGKQLVRVAHE

SEQ ID NO: 1238 - protein, 215 aa, Capsicum annuum
MSTLRIPEVVPSPTEDSQTLMKSFKVLWLCVGLGTNEKSVISVLGHRDASQRKKIRETYQQLYNKSLIDDICSELSGDFRKAVMLWTYEPSERDARLANEALKSRKKTITQLQVIVEIACASSPDHLVAVRQAYCGLFNRSLEEDITANVPMPVQKLLIGLVRSYRYDKELVDPDTANAEAAILREAIRTKQLDNDNFLIILNTRNVHQLRATFE

SEQ ID NO: 1239 - protein, 151 aa, Capsicum annuum
MGVQEKDPLLQLSLPPGFRFYPTDEELLVQYLCKKVAGHNFPLQIIGEIDLYKFDPWVLPSKAMFGEKEWYFFSPRDRKYPNGSRPNRVAGSGYWKATGTDKVITSQGRKVGIKKALVFYVGKAPKGSKTNWIMHEYRLFETSRKNGSSKQ

SEQ ID NO: 1240 - protein, 212 aa, Capsicum annuum
MTTAARPTWAPAKGGNEQGGTRIFGPSQKYSSRDIAAHTTLKPRKDGQDTQDELQKRNLREELEDRERRHFSKDKGYNDDRDRRKGSQLLLEGAKREIEDRIVPRSADADDADVDVKSDDESDDDDDDEDDTEALLAELEQIKKEKAEEKLRKERQEQEEELKAKEAELLRGNPLLNNQPTTFSVKRRWDDDVVFKNQARGEMKATKRFIND

SEQ ID NO: 1241 - protein, 233 aa, Vinca minor
  misc_feature (124)..(124): Xaa can be any naturally occurring amino acid
HKLPQLSLAVLLLLFCSLVSSEIIFEERFEDGWQSRWVRSDWKRAEGKAGSFKHTAGKWSGDPDDKGIQTSTDARHFAISAKIPEFSNKNRTLVIQYSIRFEQDIECGGGYIKLLSGFVNQKKXGGDTPYSFMFGPDICGTQTKKLHVIYSYQGQNYPIKKDLQCETDKLTHFYTFILRPDATYSILIDGRERDSGSLYTDWDILPPSTIKDVNGTKPADWDDREYIEDPHEL

SEQ ID NO: 1242 - protein, 187 aa, Petunia x hybrida
STDSTSSSAVNKVDADTDCLDYEILWEDMTIGEQIGQGSCGTVYHALWFGSDVAVKVFSRQEYSDDVIYSFRQEVSLMKRLRHPNILLFMGAVTSPQRLCIVTEFLPRGSSFRLLQRNASKLEWRRRILMALDIARGMNYLHHFNPPIVHRDLKSSNLLVDKNWTVKVGDFGLSRLKHETYLTTQSG

SEQ ID NO: 1243 - protein, 96 aa, Petunia x hybrida
MGATVDLFFRKELPLRGFDVEMRAVVARNLEGRGINLHPCTTLTKLEKTADGIKVHTDHGEVILADVVLFATGRLPNTKRLNLDAVGVELDKMEAV

SEQ ID NO: 1244 - protein, 301 aa, Pinus taeda
NSARGSSFSTSSSAVQKLEMDVDSLDYEILWEDLTIGEQIGQGSCGTVYHGLWYGSDVAIKVFSEQEYSTELIDTFRKEVSLMKRLRHPNILLFMGAVTSCERLCIVSEFLPRGSLFRLLQRNTPGMDWKRRVRMALDIARGMNYLHHLNPPIVHRDLKSSNLLVDKNWTVKVGDFGLSRLKNSTFLTAKSGKGTPQWMAPEVLRNEPSNEKSDVYSFGVVLWELATEKIPWENLNPMQVVGAVGFMNQRLEIPQGLDSNWASIIESCWHDDTQCRPTFQELIERLKDIQKHYSGPSPQKS

SEQ ID NO: 1245 - protein, 273 aa, Pinus taeda
MSFQDLEAGRPLSVRREAINGKQDPSQAVAAGVFQINTAVSTFQRLVNTLGTPKDTPELRERLHKTRQHIGQLVKDTSAKLKAASETDQHTAVSANKKIADAKLAKDFQAVLKEFQKGQRLAAERETAYTPFIPQAVLPSSYVASELNLSPDKTQEQQAVLIESRRQEVLQLENEVVFNEAIIEEREQGIQEIQQQIGEVNEIFKDLAVLVHEQGVMIDDIDSNIESSYSATVQAKSQLHKASKSQKSNSSLTCLLLVIFGVVLLIVIIVLAA

SEQ ID NO: 1246 - protein, 237 aa, Ananas comosus
QRERERECPAGELAPSMAAETDDQLLKSFLAEVSEVERDNEVRRILSCFQLNPFEHLKLPFDSSPDEVKKQYRKLSLLVHPDKCRHPQAKEAFAALAKAQQLLLDPQERDYILNQVSAAKEELRLKRKKELKKDNASKIKALVDEGKYEVQYKQSEEFQQQLKIKVREILTEQEWRRRKMQMRISEEEGRLKKDEEETKEMMKRKREHEEQWEETRDRRVSSWRGFMKSGKKVRKAR

SEQ ID NO: 1247 - protein, 286 aa, Ananas comosus
IAVEFASIWRGFGVTVDLFYRKELPLRGFDDEMRAVVARNLEGRGIKLHPGTNLTELSKTDDGIRVLTDHGDEITADVVLFATGRGPNTKRLNLEAVGVELDKKGAIKVDEYSRSTVPNIWAVGDVTNRLNLTPVALMEGTCFAKTVFGGQPTKPDYKDIPCAVFSIPPLSVVGLSEQQAIEQGKSDVLVYTSTFTPTKYTISGRQEKTLMKLIVDSETDRVIGASMCGPDAAEIMQGIAVALNCGATKAQFDSTVGIHPSAAEEFVTMRTLTRRVNAGSKPKTNL

SEQ ID NO: 1248 - protein, 157 aa, Ananas comosus
AVKYYTDDWPSHAAKLAFEKSVFTKTEKTNARTEAEIVMFDGYIVVYKFIQDLHFFVTGGDNENELILATVLQGFFDAVDLLLRNNVDKRTALENLDLIFLCLDEIVDRGIVLETEASVIAEKVASHSLDGATSFSEQTISQALATAREHLARSLLK

SEQ ID NO: 1249 - protein, 315 aa, Populus trichocarpa
MLRNLLWATSKNDVYLMQNYSVMHWSSLLRRGKEVLNVAKPVAPTRQSPGLLSQSLSRVQISTMAVKENLMVAGGFQGELICKCLDQPGVAFCSKITTGENAITNAVDVYRNHNGSMRIMAANNDAQVRVFDAETFASLNCFSFDWSVNNTSVSPDGKLLAVLGDSAECLIADANSGKVTGSLKGHLDYSFSSAWHPDGLILATGNQDTTCRLWDIRNLSQSLAVLKGNMGAIRALKFTSDGKFLAMAEPADFVHVFDTQSDYLKCQEIDLFGEIAGISFSPDTEALFVGVADRTYGSLLEFNRRHYNFYLDSIF

SEQ ID NO: 1250 - protein, 446 aa, Populus trichocarpa
MDHFQNNDLEYVVDDPFGDDLFREDEPQRNDDLDDAVDSEFEDDFESSKPQTDTSALEARNGKDIQGIPWERLNFTRDKYRETRLKQYKNYENLSLPRFELDKECLEVEKGQTFYDFQYNTRLVKSTIVHFQLRNLLWATSKHDVYLMQNYSVMHWSSLLRHGKEVLNVAKPIAPTWQRPGLLSKSLSRVQISTMAVKENLMVAGGFQGELICMYLNQPGVAFCTKITTGENAITNAVDVYHNHNGSMRIMVANNDAQVRVFDAETFASLNTFSFNWSVNNTSVSPDGKLLAVLGDSAECLIADANSGKVTGSLKGHLDYSFASAWHSNGQVLATGNQDTTCRLWDIRNLTQSLAVLKGNMGAIRGLKFSSDGRFLAMAEPADFVHVFDTQSDYVKCQEIDIFGEIAGISFSPDTEALFVGIADRTYGSLLEFNRRHCNFYLDSIF

SEQ ID NO: 1251 - protein, 446 aa, Populus trichocarpa
MDHFHNNDLEYVVNDPFEDDFFSEDEPQRNDDSDDAMNSDFEDDFVSSKPKTDTSALEARNGKDIQGIPWERLNFTRDKYRETRLKQYKNYENLSRPRFELHKECLEVEKGKTFYDFEFNTRLVKSTIVHFQLRNLLWATSKNDVYLMQNYSVMHWSSLLRRGKEVLNVAKPVAPTRQSPGLLSQSLSRVQISTMAVKENLMVAGGFQGELICKCLDQPGVAFCSKITTGENAITNAVDVYRNHNGSMRIMAANNDAQVRVFDAETFASLNCFSFDWSVNNTSVSPDGKLLAVLGDSAECLIADANSGKVTGSLKGHLDYSFSSAWHPDGLILATGNQDTTCRLWDIRNLSQSLAVLKGNMGAIRALKFTSDGKFLAMAEPADFVHVFDTQSDYLKCQEIDLFGEIAGISFSPDTEALFVGVADRTYGSLLEFNRRHYNFYLDSIF

SEQ ID NO: 1252 - protein, 253 aa, Populus trichocarpa
MSFQDLEAGRPLASSRRELINGKQDATQAVASGIFQINTAVSTFQRLVNTLGTPKDTPELREKLHRTRLHIGQLVKDTSARLKQASETDHYAGVSQSKKIADAKLAKDFQAVLKEFQKAQRLAAERETAYAPFVPQAVLPSSYTASEVNVSSEKSPEQRALLVESRRQEVLLLDNEIVFNEAIIEEREQGIHEIQQQIDDIGSHIESAQAATSQGTSQLVKAAKTQRSNSSLACLLMVIFGIVILIVIVVLAA

SEQ ID NO: 1253 - protein, 202 aa, Populus trichocarpa
MSFQDLEAGRPLASSRRELINGKQDATQAVASGIFQINTAVSTFQRLVNTLGTPKDTPELREKLHRTRLHIGQLVKDTSARLKQASETDHYAGVSQSKKIADAKLAKDFQAVLKEFQKAQRLAAERETAYAPFVPQAVLPSSYTASEVNVSSEKSPEQRALLVESRRQEVLLLDNEIVFNEAIIEEREQGIHEIQQQIGEMI

SEQ ID NO: 1254 - protein, 342 aa, Populus trichocarpa
GFGEKGKPASGDESAVPPNANIQITLELVAWKTVTEVTDDKKVIKKILKEGDGYDRPNEGAVVKVKLIGKLQDGTVFFKKGQDDSELFEFKTDEEQVIDGLDRAVSTMKKGELALLTIAPEYAFGSSESQQELAVVPPNSTVCYEIELVSFDKEKESWDMNTDEKIEAAGKKKEEGNVLFKAGKYAKASKRYEKAVKYIEYDSSFSEEEKKQAKALKVACNLNNAACKLKLKDYKQAEKLCTKVLELESRNVKALYRRAQAYIQLADLDLAEFDIKKALEIDPDNRDVKLEHKTLKEKMKEYNKKEAKFYGNMFAKMSKLGSLESNKAEAKEAEPMSVDSEA

SEQ ID NO: 1255 - protein, 274 aa, Populus trichocarpa
MSFQDLEAGRPLASSRRELINGKQDATQAVASGIFQINTAVSTFQRLVNTLGTPKDTPELREKLHRTRLHIGQLVKDTSARLKQASETDHYAGVSQSKKIADAKLAKDFQAVLKEFQKAQRLAAERETAYAPFVPQAVLPSSYTASEVNVSSEKSPEQRALLVESRRQEVLLLDNEIVFNEAIIEEREQGIHEIQQQIGEVNEIFKDLAVLVHEQGAMIDDIGSHIESAQAATSQGTSQLVKAAKTQRSNSSLACLLMVIFGIVILIVIVVLAA

SEQ ID NO: 1256 - protein, 465 aa, Populus trichocarpa
ASSECEELEESKNRVGNAKEQRLPGPQPLPLPSPQGGAVLKPMSSFKAVNCSGPLYASGPLPRPPGGTLRNFSYEEILSACRNFSSDRCVSEGLSSIMFWASFGDDASSSKRFEASVTRLHSSSQGLKEFINEVNTLASLQHPNLCKLLGYHARDGSDQRMLVYERLYHGSLDRLLYGRSDGPPIDWNTRMKIALCAAQGLTFLHEEGPFQAMYNEFSTANIQIDKDFSAKLSGYGCVGHIPETEISNSSVAAANLSVETVERGLLTPKSNVWSFAIVLLELLTGRKNLDSRHPREERNLVKWTRPFLADDCRLSLIMDPQLKCRFPAKAARTLADIALRCLQKDPLERLTMRTIVEHLKVIQDMKYSSRFPLQEPAAVAGKQMSRSPSLNGIITPTPRLSFSQSPPSRARPSISPTRPRALPLSLPPRACSSTLSLEELELELERQESRKSSSSAVRRPSVEGF

SEQ ID NO: 1257 - protein, 347 aa, Populus trichocarpa
QNLRQACFYKVASESKKPWLWWDYVTDFSIRCPMKDKKYTKECADQVIQSLGVDLEKIDKCIGEPEADVENEVLKAEQDTQIGKGSRGDVTILPTLVINNRQYRGKLDKGAVLKAICAGFEETTEPAICLSEDVETNECLENNGGCWQDKAANLTACKDTFRGRVCECPVVQGVKFVGDGYTRCEASGSLRCEINNGGCWKKTQDGRTFSACVEDHSQGCKCPPGFKGDGVNSCEDVDECKDKLACQCSECKCKNTWGSYDCSCGGGLLYMQEHDTCISKAANTNYSWSFVWIIILGLAAAGVAGYAIYKYRIRRYMDSEIRAIMAQYMPLDSQADIPVHHAPRGDI

SEQ ID NO: 1258 - protein, 274 aa, Populus trichocarpa
MSFQDLEAGRPLASSRRELINGKQDATQAVASGIFQINTAVSTFQRLVNTLGTPKDTPELREKLHKTRLHIGQLVKDTSARLKQASETDHYAGVSQSKKIADAKLAKDFQAVLKEFQKAQRLAAERETAYTPFVPQAVLPSSYTASEIDVSLDKSPEQRALLVESRRQEVLLLDNEIAFNEAVIEEREQGIHEIQQQIGEVNEIFKDLAVLVHEQGTMIDDIGSHIENSQAATAQGKSHLVKAAKTQRSNSSLACLLMVIFGIVILIVIVVLAA

SEQ ID NO: 1259 - protein, 498 aa, Populus trichocarpa
MPRKMPIDGEVNQASQVEEDAHFDFDLFVIGAGSGGVRAARFSANYGAKVGICELPFHPISSEVNGGVGGTCVLRGCVPKKILVYGANFGGEIEDARNYGWEINEKVDFNWKKLLQKKSDEIVRLNGIYKRLLSNAGVKLYEGEGKVAGPNEVELTQLDGTKLKYSAKHILIATGSKAQRPNIPGQELGITSDEALSLEDLPKRAVVLGGGYIAVEFASIWRGMGATVDLFLRRELPLRGFDDEMRAVVARNLEGRGINLHPRTNLTELTKTEDGIKVRTDHGEELLADVVLFATGRAPNTKRLNLEAAGVELDKTGAVKVDEFSRTNIPSIWAAGDVTNRMNLTPVALMEGSCFAKTVFAGQPTKPDYNHIPYAVFSIPPLSVVGLSEEQALDQANGDVLVFTSTFNPMKNTISGRQEKTVMKLVVDAETDKVLGASMCGPDAPEIMQGIAVALKCGATKQQFDSTVGIHPSAAEEFVTMRSVARRVTASGKPKTNL

SEQ ID NO: 1260 - protein, 296 aa, Solanum tuberosum
GKTVSSVTDDKKVIKKILKEGEGFEKPNAGAVVKMKLIGKLQDGTVFIKKGHNGENEDELFEFKTDEEQVIDGLDRAVMSMKKGEVALLIIAPDYAFGPSESKQDLGVVPPNSTVYYEVELVSFVKEKESWDMNTQEKIEAAVKKKEEGNALFKAGKYARASTRYEKAAKFIEDDTDFSEEEKKQAKALKISCNLNNAACKLKLKDYKQAEKLCTKVLETESTNVKALYRRAQAYMNMTDLDLAEFDIKKALEIDPNNRDVKLEYKALKEKVKEFNKKDAKFYGNMFAKLNKLDAN

SEQ ID NO: 1261 - protein, 621 aa, Solanum tuberosum
MKVGFLVCIWFVLCGCCMGRFVVEKNSLRVTSPDSIKEVYECAIGNFGVPQYGGTMVGNVMYPKTNQKSCKNFSDFDIFYKSKPGGMPVFLLVDRGDCFFTLKAWNAQQAGAGAILVADDRVEPLITMDTPEEEDAKADYLQDITIPSALISKSLGDSIKKELSKGEMVNINLDWREALPHPDDRVEYEFWTNSNDECGPKCESQREFVKNFKGAAQILEQKGYTQFSPHYITWYCPEAFILSKQCKSQCINHGRYCAPDPEQDFSKGYDGKDVVLQNLRQACFFKVANESGKPWLWWDYVTDFAIRCPMKEKKYTKECADQVIKSLGFDVKQIENCVGDPEADTDNPVLKAEQDTQIGKGARGDVTILPTLVINNRQYRGKLDKGAVLKAICSGFEETTEPAICLTEEIETNECLESNGGCWQDKAANITACQDTFRGRVCECPVVQGVKFVGDGYTHCEASGALRCEINNGGCWKGTQNGRAYSACIDDHTKGCKCPPGFKGDGVNSCEDIDECKEKLACQCAECKCKNTWGSYDCSCNANLLYMHEHDTCISKDAKSEFSWGLVWTIILGLAVAGVSAYAVYKYRIRRYMDSEIRAIMAQYMPLDQGEGATNVPHGNV

SEQ ID NO: 1262 - protein, 262 aa, Solanum tuberosum
MGRRSSQRRNAAMLDSDDTDSVSSSSTTRSDMMLSGLEEVQFDKETVLDQCVDALYEKRGSTREKALASIIEAFNSNVQHEFVEKKFATLLQLCLSSIRRGSSKEIALASHVIGLLSLTAGPGDKAHEILEESVKPISVALKSRSDNSKISSLLECLAIITFVGGKDPEETEESMQLMWQVINPKLGPNVATAKPSPAMITAVVSSWSFLLTTMDGWTLNPKSWQGSISYFSNLLDKEDRSVRIAAGETLALVFEVEIYWNF

SEQ ID NO: 1263 - protein, 432 aa, Solanum tuberosum
ALSKNEKRKSLLLGFSLESFLLVLLLFSIITSSLSEIFFEEQFDDDWQSRWVKSDWKRSEGKAGSFKHTAGKWAGDPDDKGIQTSSDAKHFAISAKIPEFSNKNRTLVVQYSIKLEQDIECGGGYIKLLSGYVNQKKFGGDTPYSMMFGPDICGTQTKKLHVILSYQGQNYPIKKDLQCETDKLTHFYTFILRPDASYSIWIDGRERDSGSMYTDWDIFPPRKIKDVNAKKPADWDDREYIEDPNEVKPEGYESIPREIPNPKAKKPDHWDDEEDGIWRPPKIPNPAYKGPWKRKKVKNPNYKGKWKTPWIDNPEFEDDPDLYVLRPTKYVGIEVWQVKAGSLFDNILICDEPDYAKKVIEEVFANREAEKEAFEEAEKVRKAKEEEEAQRAREEGERRRSERDRDRGRDRHRDRNKRRYRRDYDDDYHDEL

SEQ ID NO: 1264 - protein, 273 aa, Solanum tuberosum
MSFQDLESGRPLGSRRFQTNGKQDPTQAVASGIFQINTAVSTFQRLVNTLGTPKDTPELREKLHKTRVHIGQLVKDTSAKLKQASETDHHADVSASKKITDAKLAKDFQAVLKEFQKAQRLAAERETAYTPFIPQTVLPSSYTASEVDVASDNSMEQRALLVESRRQDILHLDNEIAFNEAIIEERDLGIQEVQQQIGEVNEIFKDLAVLVHEQGTMIDDIGSNIENSHAATAQGRSQLAKAAKTQRSNSSLTCLLLVIFGIILLIVIIVLAV

SEQ ID NO: 1265 - protein, 621 aa, Solanum tuberosum
KLGFLVCVWFLVIGSCLGRFVVEKNSLRVTSPDSIKDVYECAIGNFGVPQYGGTMVGIVVYPKANQKSCKDFADSDISFKTKAGGMPVFVLVDRGDCYFTLKAWNAQKAGAAAILVADDRNEPLITMDTPEEEDAKADYLQNITIPSALISQSLGDSIKKQLSKGEMVNINLDWREALPHPDERVEYEFWTNSNDECGPKCESQREFVKNFKGAAQILEQKGYTQFSPHYITWYCPEAFILSKQCKSQCINHGRYCAPDPEQDFSKGYDGKDVVLQNLRQACFHKVANESGKPWLWWDYVTDFGIRCPMKEKKYNKECADQVIKSLGFDVKQIDKCVGDPEADADNPVLKAEQEAQIGKNSRGDVTILPTLVINNRQYRGKLDKGAVLKAICSGFEETTEPAICLTDDIQTNECLESNGGCWQDKAANITACRDTFRGKVCECPTVQGVKFVGDGYSHCEASGALRCGLNNGGCWKGTKDGRTFSACIDDHTKGCKCPPGFKGDGVNVCDDIDECKERLACQCPDCKCKNTWGGYQCSCSGNLLYMQEHDTCIGNDGKAAFSWGLVWVIILGLAVAGVGAYAVYKYRIRRYMDSEIRAIMAQYMPLDNQGEVPNHISHGNV

SEQ ID NO: 1266 - protein, 574 aa, Solanum tuberosum
MDEDFGIPPVEGMNEDMDLPDDSSTLKVGEEKEIGNQGLKKKLVKEGEGWDTPAPGDEVEVHYTGTLLDGTKFDSSRDRGDPFKFTLGQGQVIKGWDQGINTMKKGENAIFTIPPELAYGESGSPPTIPPNATLQFDVELLSWVSVKDICKDGGIFKKILTEGEKWENPKDLDEVFVKYEAQLENGTVVGKSDGVEFTVQDGHFCPALAKAVKTMKKGEKVQLTVKPQYGFGEKGKPASSDGGAVPPNATLQINLELVSWKTVSNVTDDKKVLKKILKEGEGYERPNEGAVVKLKLVGKLLDGTVFTKKGHDGENEDNLFEFKTDEEQVIDGLDRAVLTMKKGEAALLTIAPEYAFGSSESKQDLAVVPPNSTVHYEVELVSFVKDKESWDMNTPEKIESAGKKKEEGNALFKAGKYARASKRYEKAAKFIEYDTSFSEEEKKQSKALKITCNLNNAACKLKLKDYKQAEKLCTKVLELDSANVKALYRRAQAYMNMADLDLAEFDIKKALEIDPDNRDVKLEYKALKEKVKEINKKDAKFYGNMFAKLTKQDAANSANSAPKEPEPMSIDSKA

SEQ ID NO: 1267 - protein, 358 aa, Solanum tuberosum
MGVQEMDPLTQLSLPPGFRFYPTDEELLVQYLCRKVAGHDFSLQIIAEIDLYKFDPWVLPSKAIFGEKEWYFFSPRDRKYPNGSRPNRVAGSGYWKATGTDKIITTEGRKVGIKKALVFYIGKAPKGTKTNWIMHEYRLSEPTTKSRSSRLDDWVLCRIYKKNSGGQKPSCSDLQSKDINNGSSSSSSSQFDDMLESLPAIEDRYFSLPRVNSIRNFQQDEKLNLQQLGSGNFDWATIAGLNSFPELASGNQVPAPGNQTPVLMNTNQYHNHNHNSNLNNFNEFFANSTALNFHSEVKFEGGVDQEVESSVRAQRLNSVNPGFFQENSTGFPSFYTNSVPDPFGIRYPTQTVNMGFTG

SEQ ID NO: 1268 - protein, 242 aa, Solanum tuberosum
EESKMEIVMFPWLAYGHLIPYMNLSNEIAKRGHKISFLLPKNAEIILQKFNHYPNLIKLHKLTIPHVDGLPYGAETTADVHTSLESLLATAFDELYDEIKSFLQNLKPHFIIFDFAYWIPDLALEIGGIKTLFYRVVCPAVSSATLIRSPDKAIFMASTAAELVKPPPGYPSTTVVLRECEAKLLSFIFHEYGKGVTFYERIKKGMTRCDAIAMKTCREIEGNFCDYISTPFEKPVLYTGTC

SEQ ID NO: 1269 - protein, 885 aa, Solanum tuberosum
RVMGDNRGLGVLGVSMCGAAQEIEQLSRESSHYSLSTGILPSLGARSNRRVKLKRFIISPYDRQYRLWETFLIVLVVYTAWVSPFEFGFLGKPEGPLAKTDNVVNGFFAIDIILTFFVAFLDRATYLLVDEHKKIAWKYMSTWFLFDVISTIPSELAVKISPKPLRQYGLFNMLRLWRLRRVSSLFARLEKDRNFNYFWVRCAKLVCVTLFAVHCAGCFYYLIAAHYPDPKKTWIGASMDDFLNQSLWIRYITSIYWSITTLTTVGYGDLHPENTREMIFDIFYMLFNLGLTAYLIGNMTNLVVHGTSRTRKFRDTIQAASSFAQRNQLPARLQDQMLAHLCLKFRTDSEGLQQQETLESLPKAIRSSVSHFLFYSLVDKVYLFRGVSNDLLFQLVSEMKAEYFPPKEDVILQNEAPTDFYILVTGAVDLVVLKNGVEQVVGEVRAGDLCGEIGVLCYRPQLFTVRTKRLCQLLRMNRTTFLNIVQANVGDGTIIMSNLLQHLKEMKNPIMEGVLLETEHMLARGRMDLPLTLCFATLRSDDLLLHHLLKRGLDPNEADNNGRSALHIAASKGIENCVVLLLDFGADPNSRDSEGNVPLWEAIMGKHESVIQLLVNNGAKLSAGDVGHFACVAVEQNNLSLLKEIVRYGGDVTLPKINGSSALHVAVCEGNIEIVKYLLDRGANVDQPDEHNWTPRDLAEQQGHEDIKELFESRVMMRTRSVDPIPEERCRFLGRFKSEPTITPASHGVSFLGLDGSLGRSRPRRRSNNFHNSLFGIMSAKQTNEHDLLSANDSNVSVMTTKTYAPRVTVCCPEKGDNGGKLILLPQSFKELLQIGSSRYGISQAKVVSKDGAEIDEIELIRDGDRLVFVSDKDNNIDEAKSSEL

SEQ ID NO: 1270 - protein, 242 aa, Solanum tuberosum
MGEEISNKQILLKDYVNGFPKESDMELKISSMKLKVPEDSNSVLVKNLYLSCDPYMRPRMKKTKGSYTDSFTPGSPIVGFGVAKVVDSAHPKFKKDELVWGITGWEEYSVIKAPETLFKIHNTDVPLSYYTGILGMPGITAYGGFYELCSPKKGETVYVSAASGAVGQLVGQFAKLIGCYVVGSAGSKEKVELLKKQVGFDEAFNYKEEQDLSAALKRYFPDGIDIYFEKRGGKMLDAVLLT

SEQ ID NO: 1271 - protein, 172 aa, Solanum tuberosum
MSFQDLEAGRPLGTRRGYMNGKQDPTQAVASGIFQINTAVSTFQRLVNTLGTPKDTPELREKLHKTRVHIGQLVKDTSAKLKQASETDHRVEVSASKKITDAKLAKDFQAVLKEFQKAQRLAAERETAYTPFVPQAVLPSSYTASEIDVSSEKSPEQRALLVESRRPEVLLL

SEQ ID NO: 1272 - protein, 230 aa, Solanum tuberosum
MKRLRHPNILLFMGAVTSPQRLCIVTEFLPRGSLFRLLQRNASKLEWRRRIHMALDIARGMNYLHHFNPPIVHRDLKSSNLLVDKNWTVKVGDFGLSRLKHETYLTTKNGKGTPQWMAPEVLRNEPSDEKADIYSFGVILWELATEKIPWDNLNSMQVIGAVGFMNQRLDIPKNVDPQWVSIIESCWHSEPQLRPTFLELVDKLKDMLRQYAIQAQAARNVAGDSSQKEL

SEQ ID NO: 1273 - protein, 343 aa, Solanum tuberosum
MGEEISNKQILLKDYVNGFPKESDMELKISSMKLKVPEDSNTVLVKNLYLSCDPYMRPRMKKTEGSYTDSFTPGSPIVGFGVAKVVDSAHPKFKKDELVWGITGWEEYSVIKAPETLFKIHNTDVPLSYYTGILGMPGITAYGGFYELCSPKKGETVYVSAASGAVGQLVGQFAKLVGCYVVGSAGSEEKVELLKNKFGFDEAFNYKEEQDLSAALKRYFPDGIDIYFENVGGKMLDAVLLNMRIHGRIAVCGMISQYNLEQNEGVHNLFCLISKRLRMQGFLAVDYFPLYKKFVEMVTPHIKEGKVKYVEDIAEGIESAPGALVGLFSGRNVGKQVVLVARE

SEQ ID NO: 1274 - protein, 440 aa, Solanum tuberosum
MGRRSSQRRNAAMLDSDDTDSVSSSSTTRSDMMLSGLEEVQFDKETVLDQCVDALYEKRGSTREKALASIIEAFNSNVQHEFVEKKFATLLQLCLSSIRRGSSKEIALASHVIGLLSLTAGPGDKAHEILEESVKPISVALKSRSDNSKISSLLECLAIITFVGGKDPEETEESMQLMWQVINPKLGPNVATAKPSPAMITAVVSSWSFLLTTMDGWTLNPKSWQGSISYFSNLLDKEDRSVRIAAGETLALVFEVGSLEKFSGESKGSGDSSTFETNKSKELLHIQGLRAKVLNQVRTLSAEAGGKGSAKKDLNNQRNTFRDILEFLEDGYSPETSAKIGGLLVSTSTWANLIQLNFLKHFLGGGFVKHMQENEFLHDVFGFTPKKNLPASQHRVSGTDKRMYKSPNSILNKARTQFLNKQRMLSQDKNVGYYAGGDEL

SEQ ID NO: 1275 - protein, 240 aa, Solanum tuberosum
MSFQDVHAGRSSGPRRSNVNGKQDPTQAMASGIFQINTAVSTFQRLVNTLGTPKDTPELRDKLHKTRLHIGQLVKDTSAKLKQASETDHRIEVSASKKITDAKLAKDFQAVLKEFQKAQRLAAERETSYSPVVPPAVLPSSYTDSEIDVSSDKGQEQRALLVESRRQEVVLLDNEISFNEAIIEERDQGIQEVQQQIGEVNEIFKDLAVLVHEQGTMIDDIGSNIENSHAATAQGRNTLC

SEQ ID NO: 1276 - protein, 590 aa, Solanum tuberosum
MLEVDEKDRVPAGGNRKTYARSISWSDRSPTKSSAKPQWNSKARACLPPLQPLSITRPTAEEWPRAGSDDLGVWPNPSTPGVRLGSFSTHEGSATKQAPREFEFKKDKLAFFNKECSKIVDHIYLGSDTVAKNRDILRENGITHVLNCVGFSCPEYFKDDLVYKTLWLQDSPTEDITSILYDVFDYFEDVREQGGRVFVHCFQGVSRSASLVIAYLMWKEGMSFEDAFQHVKAARGVTNPNMGFACQLLQCQKRVHAQPVSPTSVLRMYRMAPHSPYDPLHLVPKMLSEPGAEGLDSRGAFLVLIPSVIYVWIGKHCTSVMSDNARAAAFQVIRYEKAQGPVLIINEGKEPSDFWSALSQESFFSGGCGKEKTKVDARLLAENDLITDDISQCIGQKNEYDLDFEIFCKALAGGVVPPFPLSGTESETCLPARQNGWSRLRRKFSSGIMKEFITASKLYSHTGITSHVHDKMDTIKELSPALPSSPSSPQCGSPNSFSSYATSSPSWTKDPCRDVENPGLDTEPALSPSPSFSSLDSLSCFLVSKPKSNTTSPSLSPSTSDYSSSFTFSPSSSNWSDLGIPICTAFTYKI

SEQ ID NO: 1277 - protein, 621 aa, Solanum tuberosum
MKVGFLVCIWFVLCGCCMGRFVVEKNSLRVTSPDSIKEVYECAIGNFGVPQYGGTMVGNVMYPKTNQKSCKNFSDFDIFYKSKPGGMPVFLLVDRRDCFFTLKAWNAQQAGAGAILVADDRVEPLITMDTPEEEDAKADYLQDITIPSALISKSLGDSIKKELSKGEMVNINLDWREALPHPDDRVEYEFWTNSNDECGPKCESQREFVKNFKGAAQILEQKGYTQFSPHYITWYCPEAFILSKQCKSQCINHGRYCAPDPEQDFSKGYDGKDVVLQNLRQACFFKVANESGKPWLWWDYVTDFAIRCPMKEKKYTKECADQVIKSLGFDVKQIENCVGDPEADTDNPVLKAEQDTQIGKGARGDVTILPTLVINNRQYRGKLDKGAVLKAICSGFEETTEPAICLTEEIETNECLESNGGCWQDKAANITACQDTFRGRVCECPVVQGVKFVGDGYTHCEASGALRCEINNGGCWKGTQNGRAYSACIDDHTKGCKCPPGFKGDGVNSCEDIDECKEKLACQCAECKCKNTWGSYDCSCNANLLYMHEHDTCISKDAKSEFSWGLVWTIILGLAVAGVSAYAVYKYRIRRYMDSEIRAIMAQYMPLDQGEGATNVPHGNV

SEQ ID NO: 1278 - protein, 426 aa, Solanum tuberosum
MFYPSPFGVFSNLVKVEHSGDESEGKQGISKIITSKAEAWMAKNSLSWPWKGNEREASESRTTRSVWPWLNNDQDNELNHINSSNTVKPENQVTETYRTTTNEAPGSWSSFNINSTSSVSSYGSTCSSAVNKVDMDTDCLDYEILWEDLTIGEQIGEGSCGTVYHGLWYGSDVAVKVFTKQEYSDEVIYSFKQEISLMKRLRHPNILFMGAVTSPQRLCIVTEFLPRGSLFRLLQRNASKLEWRRRIHMALDVARGMNYLHHLTPPIVHRDLKSSNLLVDKNWTVKVGDFGLSRLKHETYLATRTGKGTPQWMAPEVLRNEPSDEKSDVYSFGVILWELATEKIPWDNLNTMQVIAAVGFMNQRLDIPKDVHPQLASIIESCWLSEPQSRPSFQELMEKLKDLQRQYVIQAQAARSTAGDSSQKEQ

SEQ ID NO: 1279 - protein, 506 aa, Solanum tuberosum
MKVGFLVCIWFVLCGCCMGRFVVEKNSLRVTSPDSIKEVYECAIGNFGVPQYGGTMVGNVMYPKTNQKSCKNFSDFDIFYKSKPGGMPVFLLVDRGDCFFTLKAWNAQQAGAGAILVADDRVEPLITMDTPEEEDAKADYLQDITIPSALISKSLGDSIKKELSKGEMVNINLDWREALPHPDDRVEYEFWTNSNDECGPKCESQREFVKNFKGAAQILEQKGYTQFSPHYITWYCPEAFILSKQCKSQCINHGRYCAPDPEQDFSKGYDGKDVVLQNLRQACFFKVANESGKPWLWWDYVTDFAIRCPMKEKKYTKECADQVIKSLGFDVKQIENCVGDPEADTDNPVLKAEQDTQIGKGARGDVTILPTLVINNRQYRGKLDKGAVLKAICSGFEETTEPAICLTEEIETNECLESNGGCWQDKAANITACQDTFRGRVCECPVVQGVKFVGDGYTHCEASGALRCEINNGGCWKGTQNGRAYSACIDDHTKVANVHQDSRGWS

SEQ ID NO: 1280 - protein, 397 aa, Solanum tuberosum
MALQVAALLPSTFSIPKEGKTSATLKDSSLFGISLSDHVKSDFGSSFKIKSGRKSSLGAIRAETMIASPGVTNAPVTGKKTLRKGCVVITGASSGLGLATAKALAETGKWHVIMACRDFLKAERAAKSAGMPKENYTIMHLDLASLDSVRQFVDNFRRSGNPLDVLVCNAAVYQPTAKEPSFTAEGFELSVGTNHLGHFLLSRLLIDDLKQSDYPSKRLIIVGSITGNTNTLAGNVPPKANLGDLRGLARGLDGLNSSAMIDGGDFDGAKAYKDSKVCNMLTMQEFHRRYHEETGITFASLYPGCIATTGLFREHIPLFRLLFPPFQKFITKGFVSEAESGKRLAQVVSDPSLTKSGVYWSWNKNSSSFENQLSEEASDVEKARKVWEVSEKLLGLA

SEQ ID NO: 1281 - protein, 159 aa, Raphanus sativus
  misc_feature (7)..(7): Xaa can be any naturally occurring amino acid
MQSMKEXASNIAASAKSGMDKTKATVEEKAEKMTTRDPLHKEMATQKKEERINEAEMQKREAREHNAARKEASGAGTGTGLGLGSATHSTTGQVGHGTGTHQMSALPGHGTGQPTGHVVDGTAATEPIGTNTGTGRTTAHNTRVGGGTTGYGTGGGYTG

SEQ ID NO: 1282 - protein, 154 aa, Raphanus sativus
  misc_feature (120)..(120): Xaa can be any naturally occurring amino acid
GSDVAVKVFSKQEYSEDVIQSFRQEVLLMKRLRHPNVLLFMGAVTSPPRLCIVSEFLPRGSLFRLLQRNASKLDWRRRIHMALDIARGMNYLHHCSPPIVHRDLKSSNLLVDKNWTVKVXDFGLSRIKHETYLTTKSGKGTPQWMAPEVLRNEC

SEQ ID NO: 1283 - protein, 228 aa, Raphanus sativus
  misc_feature (161)..(161): Xaa can be any naturally occurring amino acid
MGRKSQRKNVPMDLFDSDDDTSSISSSSTLRSERPTGMDEVQVHKDVLLDQSLDALYEKRSSTREQALASIVDAFNSDLQLEFVEKKFATLLHQCLHCTKKGSSKETSLASHVIGLLALTVGLGDQAQEILEESVTPLSQALKSGREALKITSILECLAVXTFVGGTNSEQTERSMQIIWQMIHPKLGSNVVATKPSPAVITTVVSSWAFLLTTVDRWALVPKFGKRP

SEQ ID NO: 1284 - protein, 283 aa, Raphanus sativus
  misc_feature (138)..(138): Xaa can be any naturally occurring amino acid
VYRLGYGLLALSLIHSLSWWIIVAAQIVYIKMSPRCRRTWEGFSWKAFEGLWSFFRLSAASAVMLCLESWYSQILVLLAGLLKNPELALDSLAICMSISAISFMVSVGFNAAASVRVSNELGAGNPRAAAFSTFVTTXVSLLLAIFEAVVVMSWRNVISYAFTDSPAVAEAVSDLSPFLAITIVLNGVQPVLSGVAVGCGWQAFVAYVNIGCYYVVGIPIGFVLGFTYDMGAKGIWTGMIGGTLMQTIILVIVTFRTDWDKEVEKASSRLDQWEESREPLLKQ

SEQ ID NO: 1285 - protein, 321 aa, Raphanus sativus
  misc_feature (47)..(47): Xaa can be any naturally occurring amino acid
ANTTLQIDLELVSWKTVVEVTDDKKVTKKILKEGEGYERPNEGAVVXLKLIGKLQDGTEFLKKGYGEEEEPFEFKTDEEQVIEGLEKSVMGMKKGEVALITISPEYAFGSSESKQELAVIPPDSTVCYEVELVSFIKEKESWDMNTQEKIEAAGKKKEEGNTLFKAGKYARASKRYERGVKYIEYDSSFDEEDKKKAKALKIACNLNNAACKLKLKDYKEAAKLSTKVLEMDGSNVKAMYRRAHAYMETADLDLAELDIKKALEIDPDNKEVKIEYKKLKEKVKEYNKKDAKFYSNMLAKMLEPHKEARKDTQAMSIDAKA

SEQ ID NO: 1286 - protein, 240 aa, Raphanus sativus
  misc_feature (57)..(57): Xaa can be any naturally occurring amino acid
  misc_feature (59)..(59): Xaa can be any naturally occurring amino acid
METEKKSKELGLNHLGFVRVAAIQVLVSLSNLYDYAKQNSGPLKPAVGKVEGAVTTXVXPVYNKFKDVPDTLLLFLDHKVGEVSNKFDKHAPPMAKKVVSQASVLIQATAEKAQSFVKEARTGGPKAAFNYAATEYKYFVVTSSVKVWAKLNQYKPIHVVGNKALPLAANLCGMYNDLVTDMTKRGYPVVGYLPLVPVDDIVKAYEKEQDAAQKKGDTTTASDGNKSLSSSESSSDSDTD

SEQ ID NO: 1287 - protein, 291 aa, Raphanus sativus
  misc_feature (66)..(66): Xaa can be any naturally occurring amino acid
LGGGYIAVEFASIWRGMGATVDLFFRKELPLRGFDDEMRALVARNLEGRGINLHPQTSLAELIKTXEGIKVISSHGEEFVADVVLFATGRAPNTKRLNLEAVGVELDQAGAVKVDEYSRTNIPSIWAVGDATNRINLTPVALMEATCFANTVFGGKPTKADYTNVACAVFCIPPLAVVGLSEEEAVEKATGDILVFTSGFNPMKNTISGRQEKTLMKLIVDEKTDKVIGASMCGPDAAEIMQGIAIALKCGATKAQFDSTVGIHPSSAEEFVTMRTVTRRIAYKAKPKTSL

SEQ ID NO: 1288 - protein, 230 aa, Raphanus sativus
METEKKNSKEIGLKHLGFVRVAAIHVLVSLSSLYDYAKQNSGPLKPAVGKVEGAVTTVVNPVYNTFKDVPDTLLLFLDHKVGEVSDKFDKHAPTMAKKVANQANVLIQKAQSFVKEARTGGPRAAFNYAASEYKCFLVNSSVKVWAKLNRYKPIHAVGNKALPVAAHLSGIYNELVTDMTQMGYPVVGYLPLVPVDDIVKAYEKEEGAAQRKGDAAAADGNKSSSDSDTD

SEQ ID NO: 1289 - protein, 244 aa, Raphanus sativus
FYPTDEELLVQYLCRKVAGYHFSLQVIGDIDLYKFDPWDLPSKALFGEKEWYFFSPRDRKYPNGSRPNRVAGSGYWKATGTDKIITSDGHRVGIKKALVFYAGKAPKGTKTNWIMHEYRLFEHSRSHGSSKLDDWVLCRIYKKTSGSQRQQAVAPVQPEHSTNGSSSSSSSHHEDVLDSFPEMKDRSFDLPRVNSLRTLLNGNFDWASLAGLNPIPELAPASNNGTAEEGTTRFERRRERRRAG

SEQ ID NO: 1290 - protein, 428 aa, Raphanus sativus
  misc_feature (115)..(116): Xaa can be any naturally occurring amino acid
  misc_feature (124)..(124): Xaa can be any naturally occurring amino acid
  misc_feature (126)..(126): Xaa can be any naturally occurring amino acid
  misc_feature (129)..(129): Xaa can be any naturally occurring amino acid
  misc_feature (226)..(226): Xaa can be any naturally occurring amino acid
FTTPKNQPFVSDFLSDTPVINVISLPFPENISGIPPGVESTDKLPSMSLYVPFTRATKLLQPLFEESLKNLPQVSFMVSDGFLWWTSESAAKFKIPRLVFFGMNSYASAVSISAXXHKLFTEPXTXYTXPVTVPDFPWIQVKKCELNLDTQPGPAAELLMDQIMSTTTSHGFLVNSFYELETTFVDYNNNNSESPKSWCIGPLCFTDPPKPKRAKPDWIHWLDQKXEEGRPVLYVAFGTQAEISNKQLKELALGLEDSKVNFLWVTRKDVEEIIGEGFKDRIRKTGMIVRDWVDQWEILSHESVKGFLSHCGWNSALESICVGVLLLAWPMMAEQPLNAKMVVEEIKVGLRVETQYGSVRGFVTKEELSQKVQELMEGEKGKTARKNVKEYSKMAKAALIQETGSSWKNLNLLLEKLCKSGETSEGNN

SEQ ID NO: 1291 - protein, 408 aa, Raphanus sativus
  misc_feature (269)..(269): Xaa can be any naturally occurring amino acid
MGRKMLDDGEVDKAVGAEETHYDFDLFVIGAGSGGVRAARFSANHGAKVGICELPFHPISSEEIGGVGGTCVIRGCVPKKILVYGATYGGELEDAKNYGWEINENVDFTWKKLLQKKTDEILRLNNIYKRLLSNAAVKLYEGEGRIVGPNEVEVRQIDGTKISYTAKHILIATGSRAQKPNIPGHELAITSDEALSLEEFPKRAVVLGGGYIAVEFASIWRGMGGTVDLFFRKELPLRGFDDEMRALVARNLEGRGVNLHPQTSLTQLXKTDKGIKVISSHGEEFLADVVLFATGRSPNTKRLNLEAVGVELDQAGAVKVDEYSRTNIPSIWAVGDATNRINLTPVALMEATCFANTVFGGKPTKADYSNVACAVFCIPPLAVVGLSEEEAVEKATGDILVSPQALIL

SEQ ID NO: 1292 - protein, 385 aa, Raphanus sativus
HGAHRYDMLGVYLQRSTVVLIITCLPMSLLFVFSKPLLNTLGEPEQVASMASLFVYGMLPVIFAYAVNFPIQKFLQAQSIVTPSAYISAAALVIHLVLSWVAVYRLGLGLLALSLVHSFSWWIIVGAQIVYIKMSPRCRRSWEGFSWKAFEGLWDFFRLSAASAVMLCLESWYSQILVLLAGLLKDPEIALDSLAICMSISAVSFMVSVGFNAAASVRVSNELGAGNPRAAAFSTVVTTSVSFLLAVFEAIVVMSWRNVLSYMFTDSPIVAEAVADLSPFLAITIVLNGIQPVLSGVAVGCGWQAFVAYVNIGCYYVVGIPIGFVLGFTYDMGAKGIWTGMIGGTLMQTIILVVVTLRTDWDKEVEKASSRLDQWEESRERLLKQ

SEQ ID NO: 1293 - protein, 122 aa, Raphanus sativus
MQSMKETASNIAASAKSGMDKTKATLEEKAEKMTTRDPVQKQMATQKKEAKINQAEMQKREVREHNAAMKEAAGAGTGTGTGLGLGSATHSTTGHVGHGTRTHHMSALPGHGTGQATGHVVE

SEQ ID NO: 1294 - protein, 151 aa, Raphanus sativus
MASLLDKAKDFVADKLAGVPKPEGSVTDVDLKDVNGDSVEYLAKVSVTNPYSHAIPICEINFTIHSAGREIGKGKIPDPGSLKAKDMTVLDVPMVVPYRILLNLARDVGADWDIDYLLEIGLTIDLPVVGDFTIPITSKGEIKLPTFKDFF

SEQ ID NO: 1295 - protein, 159 aa, Raphanus sativus
MQSMKETASNIAASAKSGMDKTKATLEEKAEKMTTRDPVQKQMATQKKEAKINQAEMQKREVREHNAAMKEAARAGTGTGLGLRSATHSTTGHVGHGTGTHQMSALPGHGTGQATGHVVEGTTLTKPIGTNTGTGRTTAHNTHVGGGTTGYGTGGGYTG

SEQ ID NO: 1296 - protein, 173 aa, Raphanus sativus
MGIQELDPLAQLSLPPGFRFYPTDEELMVDYLCRKAAGHDFSLQLIAEIDLYKFDAWVLPSKALFGEKEWYFFSPRDRKYPNGSRPNRVAGSGYWKATGTDKVISTEGRRVGIKKALVFYIGKAPKGTKTNWIMHEYRLIEPSRRNGSTKLDDWVLCRIYKKQSSAQDSLRYL

SEQ ID NO: 1297 - protein, 319 aa, Raphanus sativus
  misc_feature (23)..(23): Xaa can be any naturally occurring amino acid
  misc_feature (116)..(116): Xaa can be any naturally occurring amino acid
  misc_feature (119)..(119): Xaa can be any naturally occurring amino acid
MATIRVPDEVPSPAQDSETLNKXFRGWGTDEKAIIRVLGKRNESQRKRIRESYREIYGKDLIDDLSSELSGDFKKAVILWTKDPAERDARLAYKVLNEKKKTIEKLKIIVEIACTXSPXHLIAVRKAYCSLYDSSLEEHIASSVPFPLAKLLVTLATSFRYDKEKVDKEVATIEAGMLHEAITKKQLDHDHVLYIIGTRSIYQLRATFAAYKQSYGNTLDKDVDGCPGDADLRSLLQMVILCIEFPEKHFAKVVHDSIEGFGTDEDSLTRAIVMRAEIDLMKVRGEYFNMYNSSMDNAIIGDVSGDYKDFLMTLLGSKI

SEQ ID NO: 1298 - protein, 804 aa, Oryza sativa
MAVAAMELPAVRAYDALGINETSVKSMPFENLATLMQSPATLQATKAVLDRFEKLLPLLSSPVINIDHLLKHLGSPKKKKTPPPAAAASASRYSLRVVLCSYMILAHPGAVLSGQGEKEKLLMDSAGSFVKEFELLVKTVLEKQSTDAAAGQKMFSAQLADFDRAWCAYLYCFVVWKLKDAKSLEDDLVRAACKLELSMMQTCKLSSDGQSHNGLSHDMKAIQKQVADDQKLLREKVHQLSGDAGIERMNSALSDTRSKFFEAKENGNPLAASVANVSTPLSIGSSGSSFTAQSLPGAASSPSSSSLMKQPTDNEQMLNEMLHEDDVSFGGNSDNVSSAEKEFQAKVKSTMEKAFWDLVTDSMKGDKPDYTQLINLVKEVRDSLHELASKELKEEILENIDLEILSQVLESGSQDTRYLGQIMHYSLDMIRKLSAPAKEDDMKRSHEKLLNELAASSEVNDNGISSFVIAVIKGLRFTLEEIKQLQSEVSKARIQLMQPIIKGSAGVEYLQKAFADRYGPPANASASLPITKQWVSATKSIVEQEWSSHLESLQALPADHAQRVVVPALRAGHGAPMAQASSSAASGSGLPECKGEKIDKLTRVGLLQLISNVEGLNMQSTPETFQINLPRLRAVQDQFQKVIVIATSILVLHQVLVSKVAAPELQNAISELYDALVKLLDSNPDASTEEIVEAMASSLATVGSLSLPEKQAQATAELATKMLLKSLQAGDVVFGKVSRTVYCAFRGVVLGGGGVKGKKLAEAPLRRLAAAKLADRVVKAGEMLINMAVISEKVHGQWYKALAL

SEQ ID NO: 1299 - protein, 626 aa, Oryza sativa
MGLRSPNSMLWLVLLVWAALLCGSCHGRFVVEKNSLKVTSPSDMKGTYECAIGNFGVPQYGGTMVGVVAYPKANKKACKSFDDFDISYKAKPGSLPTFLLVDRGDCFFTKKAWNAQNAGAAAILVADDKTEPLITMDTPEESGNTDYLENITIPSALITKSFGDKLKKAIDNGDMVNVNLDWRESLPHPDERVEYEFWTNSNDECGPKCDSQIDFVKSFKGAAQVLEKKGYTQFTPHYITWYCPDSFILSKQCKSQCINHGRYCAPDPEQDFSKGYDGKDVVVQNLRQVCVYKVAKEHGKPWLWWDYVTDFAIRCPMKEKKYTKECADGVIKSLGLDHKAIDKCIADPDADKENPVLKAEQDAQIGKGSRGDVTILPTLVINNRQYRGKLDKGAVLKAICAGFRETTEPAVCLSEDIQTNECLENNGGCWQDKAANISACKDTFRGRVCECPVVKGVKFVGDGYTHCEASGSGHCEINNGGCWKDSRHGRTYSACTNDGCKCPDGFKGDGVHKCEDIDECKERTACQCKECKCKNTWGSYECGCSGGLLYMKEHDTCISKNAATEVGWNFLWVIFFGLVVAGIAGYAVYKYRIRRYMDSEIRAIMAQYMPLDNQGDVPNHSHHIEL

SEQ ID NO: 1300 - protein, 229 aa, Oryza sativa
MNIFKKKVDPKEALRTSKREMSVATRGVEREIGSLQMEEKKLVAEIKKTAKTGNEAATKILARQLVRLRQQIVNLQGTRAQIRGVATHTQAMYAGTSISAGMKGASKAMAAMNKQMEPTKQIKVMREFQKQSNQLDMTLEMMSDAIDETLDKDEAEEETEELTNQVLDEIGVDVASQLSSAPKGRIAASNRKAESNQARNAAPPRNNVEPESSAEVDDLERRLASLRRI

SEQ ID NO: 1301 - protein, 626 aa, Oryza sativa
MALRSPNSMLWLALLVWAALLCGSCHGRFVVEKNSLKVTSPSDMKGTYECAIGNFGVPQYGGTMVGVVAYPKANKKACKSFDDFDISYKAKPGSLPTFLLVDRGDCFFTKKAWNAQNAGAAAILVADDKTEPLITMDTPEESGNTDYLENITIPSALITKSFGDKLKKAIDNGDMVNVNLDWRESLPHPDERVEYEFWTNSNDECGPKCDSQIEFVKSFKGAAQVLEKKGYTQFTPHYITWYCPDSFILSKQCKSQCINHGRYCAPDPEQDFSKGYDGKDVVVQNLRQVCVYKVAKEHGKPWLWWDYVTDFAIRCPMKEKKYTKECADGVIKSLGLDHKAIDKCIGDPDADKENPVLKAEQDAQIGKGSRGDVTILPTLVINNRQYRGKLDKGAVLKAICAGFRETTEPAVCLSEDIQTNECLENNGGCWQDKAANISACKDTFRGRVCECPVVKGVKFVGDGYTHCEASGSGRCEINNGGCWKDSRHGRTYSACTNDGCKCPDGFKGDGVHKCEDIDECKERTACQCKECKCKNTWGSYECGCSGGLLYMKEHDTCISKNAATEVGWNFLWVIFFGLVVAGIAGYAVYKYRIRRYMDSEIRAIMAQYMPLDNQGDVPNHSHHIEL

SEQ ID NO: 1302 - protein, 331 aa, Oryza sativa
MIRGLAAHDSGKHLVLRRRAAASQLTLYCTAIGGIGAALMAAFMYHMLRRTDQLTGLWVVSIFSGLIWFIGICHGLFTNRPSSSSPTTAFEPNFFTKLSYSMTLVRYPQAIGSLVAVFLSSFATMCIFTSGTLYAIGGVCIKPVLVLVLWILYFLFPLISLPLLHPIQIIIRADAVRMQLLGFIICLFVSGAGFYFKSHRWRAAHIIVIALVQSTANGVLYSFGRILLLDASPPGKEGAFAVWYAFVRCIGAMIGFAAASAGPGRAGGSFAAAFLGSFLGIIVLIFGNVSNIGALKAAGHLKGMEDEKRLGMEKGEGMSAVADSGEGRGRV

SEQ ID NO: 1303 - protein, 230 aa, Oryza sativa
MTTAARPTWAPAKGGNEQGGTRIFGPSQKYSSRDLAAHTTLKPRKEGQHTQEELQKRNLRDELEERERKHYSSKDKSYAEERDRRKSTSLLLEGSRREAEDKIVPREIDADDSDVEPRSDDESDEDDDDDDDTEALMAELERIKKERAEENLRKERQQAEEEAKMKEAELMRGNPLININNAGSFNVKRRWDDDVVFKNQARGETKTPKRFINDTIRSDFHRKFLQRYMK

SEQ ID NO: 1304 - protein, 422 aa, Oryza sativa
MGRLRRGGVGLLRGAVVLASLLLVVSGEVIFEERFDDDWGSRWVKSDWKKSEGKAGTFKHTAGSYSGDPDDRGIQTTSDAKHFAISAKFPEFSNKNRTLVVQYSIKIEQDIECGGAYIKLMSGYVNQKKFGGDTPYSFMFGPDICGDQTKKLHLILSYQGQNYPIKKDLKCETDKLTHFYTFILRPDASYSLLVDNREREFGSMYTDWDILPPRKIKESNAKKPKDWDDREYIEDPDEVKPEGYDSIPKEIPDPKDKKPESWDDDDDGVWKPRMIPNPEYKGRWKRKKIKNPNYKGKWKIPWIDNPEFEDDPDLYVLKPLQYVGIEVWQVKAGSVFDNILICDDPEYARSVVDEVRAANKEAEKEAFEEAEKRRKAREDEEARRAREEGEKRRRDRDRHRGRDRYRDRYRGHHRRYDYHDEL

SEQ ID NO: 1305 - protein, 76 aa, Oryza sativa
MAAAAPADAKAEAAKMDLLEDDDEFEEFEIDQEWDDKEDGDEAIQQWEDDWDDDDVNDDFSLQLRKELEECNTQKI

SEQ ID NO: 1306 - protein, 569 aa, Oryza sativa
MADAAGIATVLAADGRDFLLRNSADQVKISSIEASTVALYFSASWCPPCRRFTPKLIEAYNELVSQGKNFEVVFVSGDKDQEAFDAYFAKMPWLAVPFSDSECRAKLNKRFKVRGIPHLVILNATSGEVYTEDGVELVTVHGTEAYPFTTERINELKEQEKAAKDNQTVQSVLGTPTRDYLLSNKGDRVPISDLEGKYVGLCFVVNGYGPVVQFTSLLAKFYEKLKEVGEKFEVVAVSLDSDEELSNESFAGMPWLAIPQEDKMGEKLARYFELRGLPTLVLIGPDGKTLNNNVADIIDEHGQDAWEGFPFTAEKMEILAEKAKAKAELQTLESLLVIGDLDFVLGKDGAKVPVSELVGKTVLLYFSAKWCGPCRAFLPKLVDEYNKIKEKHNDFEIIFISSDRDQSSYDEFFSGMPWLALPLGDERKQHLSKTFRVRGIPSLVAIGADGRTVARDAKTPLTAHGADAFPFTEERLLEMERKIDEMAKGWPGKLKHELHDEHELVLTRCTTYGCDGCDEMGSSWSYRCRECDFDLHPKCALGKEEEKKGDDEAEAEADPACEGGVCRKA

SEQ ID NO: 1307 - protein, 394 aa, Oryza sativa
MGSRSGGRHRLFLRFIALWSLLLIAAGEVIFEERFEDGWESRWVKSDWKRSEGKAGTFKHTAGRYSGDPDDKGIQTTLDARHFAISAKIPEFSNKGRTLVLQYSIKFEQDIECGGGYIKLMSGYVNQKKFSGDTPYSLMFGPDICGTQTKKLHLILSYQGQNYPIKKDLQCETDKLTHVYTFILRPDASYSILVDNRERESGSMYTDWDILPPRKIKDVHAKKPKDWDDREYIEDPDAVKPEGYDSIPKEIPDPKDKKPDTWDDDDDGIWKPRMIPNPAYKGPWKRKKIKNPNYKGKWKIPWIDNPEFEDDPDLYVLKPLKYIGIEVWQVKAGSVFDNILICDDPEYARKAAEETWGANREVTSHKYLQNCCLLFISARHNLSFVYIAGRKRGF

SEQ ID NO: 1308 - protein, 102 aa, Oryza sativa
YFSFPRPQAKHIDSYRRSRELQRQGSPMADTAKADAAAEAAKMDLLEDDDEFEEFEIDQEWDDKEEGNEAVQQWEDDWDDDDVNDDFSLQLRKELESIPSKN

SEQ ID NO: 1309 - protein, 581 aa, Oryza sativa; identical to SEQ ID NO: 275

SEQ ID NO: 1310 - protein, 320 aa, Oryza sativa
MGSRSGGRHRLFLRFIALWSLLLIAAGEVIFEERFEDGWESRWVKSDWKRSEGKAGTFKHTAGRYSGDPDDKGIQTTLDARHFAISAKIPEFSNKGRTLVLQYSIKFEQDIECGGGYIKLMSGYVNQKKFSGDTPYSLMFGPDICGTQTKKLHLILSYQGQNYPIKKDLQCETDKLTHVYTFILRPDASYSILVDNRERESGSMYTDWDILPPRKIKDVHAKKPKDWDDREYIEDPDAVKPEGYDSIPKEIPDPKDKKPDTWDDDDDGIWKPRMIPNPAYKGPWKRKVCFFCLWQPILLGALSFKSSYSYILLCTENQES

SEQ ID NO: 1311 - protein, 585 aa, Oryza sativa
MSEQPLPQPRSSMREALEKEDKEKAAAAKEKAAVPKNGGNGGGGKNGGGNGGGNGGAGAQPGEETTREIQVVREAYRREPAAPAYVMPEEPPAMVELVGWYLYGFCSYFITHLLLPVLFPAIITQVAFPASDFTPDTKYIVKGATCSIHEMSMYQRLTKHSIAIDGSRLSPLGWSGLSWAIGILIAAPILTQAAHHLDRGQYQSLILIAATSFGSFFCLLTGFFKTVWVFLFYILFIGASIIVAEAVHTRNLGLMIRGLAAHDSGKHLVLRRRAAASQLTLYCTAIGGIGAALMAAFMYHMLRRTDQLTGLWVVSIFSGLIWFIGICHGLFTNRPSSSSPTTAFEPNFFTKLSYSMTLVRYPQAIGSLVAVFLSSFATMCIFTSGTLYAIGGVCIKPVLVLVLWILYFLFPLISLPLLHPIQIIIRADAVRMQLLGFIICLFVSGAGFYFKSHRWRAAHIIVIALVQSTANGVLYSFGRILLLDASPPGKEGAFAVWYAFVRCIGAMIGFAAASAGPGRAGGSFAAAFLGSFLGIIVLIFGNVSNIGALKAAGHLKGMEDEKRLGMEKGEGMSAVADSGEGRGRV

SEQ ID NO: 1312 - protein, 758 aa, Oryza sativa
MEASGEELLKKIRELEVGQAQLKQEMSKLGGAAAAAERRRSQSVSPRRGAAPPPPHQPPLPARRLSGGFEGGARAWARGSASFPHSSPLQREGRAAAAAGGGLTEKQYTRVLQSLGQSVHILDLEGKIMYWNRSAEKLYGYPASEALGQDGLMLLIDSCDINVVNDIFRRISLGESWTGKFPVKNRAGDRFSAVATNTPFYDEDGSLVGIVCVSSDLRTMEEIISGPSICARPHPESSRTYCEASCSNSNRKASLLSRSPFDSQQPLQSTIASKITNLATKVTNKVRSRVRADENGIEREGGSGESHCSDRDAKEEPTSSGTTTPRGDAPRGAFATEESSPGKTAKMNSDESEGKVGFHRILSSKAEALLNKKGISWPWKGRDNDGPDVKNQATWPWLHGEQDGSQNHQKISDSAITQDGQGAEYNQPNKNEASGSWSSFNNNSTSSASSTGSTNSSALYKVDHEADCLDYEILWEDLVIGEQIGQGSCGTVYHALWYGSDVAVKVFSKQEYSEEVIQTFRQEVSLMKKLRHPNILLFMGAVTSPQRLCIVTEFLPRGSLFRLLQRNNTKLDWRRRVHMALDIARGMNYLHHFSPLIIHRDLKSSNLLVDKNWTVKVADFGLSRLKRETFLTTKTGKGTPQWMAPEVLRNEPSDEKSDVYSYGVILWELVTQKIPWENLNSMQVIGAVGFMNHRLEIPSETDPQWTSLILSCWETDSQLRPSFQQLLERLRELQRQYNVQTQMQRNASAAAKNSSIEE

SEQ ID NO: 1313 - protein, 755 aa, Oryza sativa
MEAAELVKKIRELEEGQAELKREISRIVPERGGARRPPTLPAQQRRTALPQAAAAAPSSRLLQRVGRAGLPDRHYVRILHSLGQAVHVISLDGKLMYWNRYAEHLYGYSVPEAVGQDALELIVHPSDYGAANDIIQNIFMGKCWRGKFPVKHKSGERFNIVASNTPLYDDDGSLVGLICLSTDTRTLEEILGHSTSGKVYPSSAKPRVQLNGSKSGLLNKVSCDSQQPLQSAITSRITNLATRVTNRVRSRVKTGQNCDDQFGGACESHYSEHDAREEQTSSEGSTPSGDVLHGAFVSEDNYSGKSSKTNSDDSGEGKLGLHKILSSTAEALWANRGIPWPWRGHGNDDAGKNRTNLPQFHEIQENGQSHKEVPEPIILPDCQDTEFVQEVKYEVSGSWWSFNASTSSMSSTGSTNSSAIERADREADCLDFEILWEDLAIGEQVGQGSCGTVYHALWYGSDVAVKVFSKYEYSEDMILTFRQEVALMKKLRHPNVILFMGAVASLQRLCIVTEFLPRGSLFRLLQKNAGKLDPRRRVHMAIDIARGMNYLHNSSPPIVHRDLKSSNLLVDKNWTVKVADFGLSRLKLETFLTTKTGKGTPQWMAPEVLRNEPSNENYGVILWEIATQKIPWDNLNTMQVVGAVGFMDHRLDIPSDVDPHWASMIESCWDRCTYYIYFFDISTYYFFANSEETTVLNVKQLILVFNKPILSASSDPQRRPSFQELLDQLRDLQKQYNLQAQLQRTAAAKMSVDDC

SEQ ID NO: 1314 - protein, 974 aa, Oryza sativa
MEQVRRKSSLRSHGSGKSSPRVGSGVFDERSGLAADRDGGEEGEVVVRIDGEGPCREPFAFPGQDGGGAGNVSPNTDSTASTPRGASRTWSSWTNSPRSPPKVRRDGSVEFWKNDGGGDGGSDGGGGRGGGGGGGGGRRACEAFSFKNRAPPRPSSSQASSPSLSPQPAHAAGAVDGGEDPPTRLIGNFLRKQKASGAELSLDLDMEELGRPSQLHAQPSFSNSLEREARVSFQPKRRVASSSDSDSDTGGSRRRGGDDGEVVRCTSSSTAAGHLMRAKTRSRLMDPPPQPQPASAVPPVGDEERRSSVLRTPTKSGQFISGLMTGKSGQIAKSGPLEEEEEDPFMDEDIPDEFKRGKLDAITILQWLSLVLIIAALACSLTIKALSGKKVWGLHLWKWELLVFVLICGRLVSGWVIRIAVFCVERNFLLRKRVLYFVYGVRSAVQNALWLGLVLSSWHFMFDKNVQRETNSPVLPYVQKILFCFLVATLIRLVKTLLLKVLASSFHVNTYFDRIQEALFNQFVIETLSGPPLVDENQFLAEMHELQRAGATIPAELRSTVPTKNLSGQRSIRMSGVIPKGEGSKQLSKEKGEHQIEEGITIDKLHKLNQKNISAWNMKRLMRIVRFGTLTTMDEQIQQATGEGDESATQIRSEYEAKIAAKKIFHNVAKPGSKYIYLSDLLRFMRQEEAIKTMDLFEGAQEHSRVSKRSLKNWVVNAFRERKALALTLNDTKTAVNKLNQMVNVVVGIIVFALWLLILGIATTHFFVFLSSQVLVAVFVFGNTLKTIFEAIVFLFVMHPYDVGDRCEIEDCQVVVEEMNIMTTVFLRYDNLKIYYPNSVLATKPIMNYYRSPDMGEGIDFSVHVATPVEKLALMKERLLRYIDNKKDHWYPGAMIVLRDVDDTNKLKVSIWLRHTLNWQDMGMRFVRRELVLQEMIKVLKDLDIEYRMLPLDVNVRNAPPIQSTRMPTTWNYS

SEQ ID NO: 1315 - protein, 382 aa, Oryza sativa
FSSPFYPPPRLISSPLPTTTTTTMATAASLSATASSLLAPAPATTGAAAAQCCSSSSTALFPTPVPSLRAYYPRLLLAFRRPAVAAVADPQGAVLEEEQGEQQDEGQEQYDDDDYDDGYEGGRGPAFTPPTRPRTGKAALPLKRDRTRSKRFLEIQKLRESKKEHDVPTAISLVKQMASARFVESAEAHFRMNLDPKYNDQQLRATVNLPKGTGQSVKIAVLTQGEKIDQARAAGADIVGGDDLIDQIKGGFMEFDKLIASPDMMPKVAGLGKILGPRGLMPNPKAGTVSPNITQAIEEFKKGKVEYRVDKTGIVHIPFGKVDFPEEDLIANFMAVVRSVERNKPSGAKGIYWKTAYLCSSMGPSIKLNIKEMLDYGSESSD

SEQ ID NO: 1316 - protein, 588 aa, Oryza sativa
MADAAGIATVLAADGRDFLLRNSADQTDGQMLDTDFHGCTYFGTEVKISSIEASTVALYFSASWCPPCRRFTPKLIEAYNELVSQGKNFEVVFVSGDKDQEAFDAYFAKMPWLAVPFSDSECRAKLNKRFKVRGIPHLVILNATSGEVYTEDGVELVTVHGTEAYPFTTERINELKEQEKAAKDNQTVQSVLGTPTRDYLLSNKGDRVPISDLEGKYVGLCFVVNGYGPVVQFTSLLAKFYEKLKEVGEKFEVVAVSLDSDEELSNESFAGMPWLAIPQEDKMGEKLARYFELRGLPTLVLIGPDGKTLNNNVADIIDEHGQDAWEGFPFTAEKMEILAEKAKAKAELQTLESLLVIGDLDFVLGKDGAKVPVSELVGKTVLLYFSAKWCGPCRAFLPKLVDEYNKIKEKHNDFEIIFISSDRDQSSYDEFFSGMPWLALPLGDERKQHLSKTFRVRGIPSLVAIGADGRTVARDAKTPLTAHGADAFPFTEERLLEMERKIDEMAKGWPGKLKHELHDEHELVLTRCTTYGCDGCDEMGSSWSYRCRECDFDLHPKCALGKEEEKKGDDEAEAEADPACEGGVCRKA

SEQ ID NO: 1317 - protein, 425 aa, Oryza sativa
MGSRSGGRHRLFLRFIALWSLLLIAAGEVIFEERFEDGWESRWVKSDWKRSEGKAGTFKHTAGRYSGDPDDKGIQTTLDARHFAISAKIPEFSNKGRTLVLQYSIKFEQDIECGGGYIKLMSGYVNQKKFSGDTPYSLMFGPDICGTQTKKLHLILSYQGQNYPIKKDLQCETDKLTHVYTFILRPDASYSILVDNRERESGSMYTDWDILPPRKIKDVHAKKPKDWDDREYIEDPDAVKPEGYDSIPKEIPDPKDKKPDTWDDDDDGIWKPRMIPNPAYKGPWKRKKIKNPNYKGKWKIPWIDNPEFEDDPDLYVLKPLKYIGIEVWQVKAGSVFDNILICDDPEYARKAAEETWGANREAEKEAFEEAEKERKAREDKEAERAREEGERRRRERGDRHRGRDYKDRYKRRHRDHWDDDYHDEL

SEQ ID NO: 1318 - protein, 250 aa, Oryza sativa
AGKRSVYLMDCAPVWGCASTRGRSAEMEDASAAVPRFADVPVRLLASRRDLDALGLDADALRLPAHLFGVFDGHGGAEVANYCRERIHVVLSEELKRLGKNLGEMGEVDMKEHWDDVFTKCFQRVDDEVSGRVTRVVNGGGEVRSEPVTAENVGSTAVVALVCSSHVVVANCGDSRIVLCRGKEPVALSIDHKPDRKDERARIEAQGGKVIQWNGYRVSGILAMSRSIGMHIDPCARSRLKHLSVSFPCK

SEQ ID NO: 1319 - protein, 712 aa, Oryza sativa
MEAAELVKKIRELEEGQAELKREISRIVPERGGARRPPTLPAQQRRTALPQAAAAAPSSRLLQRVGRAGLPDRHYVRILHSLGQAVHVISLDGKLMYWNRYAEHLYGYSVPEAVGQDALELIVHPSDYGAANDIIQNIFMGKCWRGKFPVKHKSGERFNIVASNTPLYDDDGSLVGLICLSTDTRTLEEILGHSTSGKVYPSSAKPRVQLNGSKSGLLNKVSCDSQQPLQSAITSRITNLATRVTNRVRSRVKTGQNCDDQFGGACESHYSEHDAREEQTSSEGSTPSGDVLHGAFVSEDNYSGKSSKTNSDDSGEGKLGLHKILSSTAEALWANRGIPWPWRGHGNDDAGKNRTNLPQFHEIQENGQSHKEVPEPIILPDCQDTEFVQEVKYEVSGSWWSFNASTSSMSSTGSTNSSAIERADREADCLDFEILWEDLAIGEQVGQGSCGTVYHALWYGSDVAVKVFSKYEYSEDMILTFRQEVALMKKLRHPNVILFMGAVASLQRLCIVTEFLPRGSLFRLLQKNAGKLDPRRRVHMAIDIARGMNYLHNSSPPIVHRDLKSSNLLVDKNWTVKVADFGLSRLKLETFLTTKTGKGTPQWMAPEVLRNEPSNENYGVILWEIATQKIPWDNLNTMQVVGAVGFMDHRLDIPSDVDPHWASMIESCWDSDPQRRPSFQELLDQLRDLQKQYNLQAQLQRTAAAKMSVDDC

SEQ ID NO: 1320 - protein, 685 aa, Oryza sativa
MARSRKRRIVQSNEEYLSEEQTEEENTLPQLATPSEQKTVCDDSGEGNEDTDDDFNINDGEGNEDTNDDVDIDDEGNEDTDVDINVRVENGAPETRGKTKLKDVWNLPKGLRIVVQCNDLNQAVGEEDGILGKFLGMISRNGSLCSLGYTDWRYVIGKREKNTNELKVKKDILKQVKMRFLYAPRMEEFILKKIGERWRQYKAKLKDLYFDVNETKEANCNNVPEGVLSDQWIALVNHWMNEKSKRISEQNKKNCQKKKAIHTAGTKSFARTREEMRQKDPAKKNPHRAVVYVHTHKRKSDKNINGHVDNLKRLIAEQPALADASKGKTAWKGDALNQILGDDKPGRVHGLGLVPKPKQVLDVPTSRRLQNINLTTVEDNSSEDVMAIRLQMEKLERHVENNDAELLQLKEKATKLEKAQKNQGGLDGASTNKKAICDDVPNSKRRRVYGDNPSQEICMFEEGNIMDQQDNSLMNTQSHVHDENLQPPTKHSTVYKRKGNLDHNELMQPGKSISSAYKNNKPDNQDNYMVNAHKVTSTHKNKENLTRKLVRPSLNKYSTASKKRQCNTIDFLTDNSTVKVYGDGPLQEICHVEQENIVMNSQSHAQDEDKTPPTKHATAHKNKRTFGLNDHGKQMEIICAKNKKPDNQDSHMVHAHKVGGAYKKQQCSKMDFITDNSMEVDKING

SEQ ID NO: 1321 - protein, 589 aa, Oryza sativa
MADESERGGMVIDDVGGGGLNLAIVAGKRKREITWEEKAALTVLDIPAERDCSLIDSEKDYSSMAGCQAGEHASIFGIDKNGDDSDEPCAKDDANQSDMAALKEEEENWELDSEPELTWDEKVVQVLNMVRHREITEYNPKQFCSIPTRFCAYNIAFFDLDKESKLARGPPIKSLAFPDYWWEMDSVNVIAIKVAESDVGYPIRVFGTVLARDEYDFRCVYLFRRDRNNPQIITSPEDTLTLTGPNRALGATDKMYFEFNLKIRDDGDVDKDFCKGVREHNAICYTKQPMTLSLESCLSTIDFVYSPVQLAVEASVAVKIKGVVSTFFTGKVTAWTTGDDQNKIILYDSEVEGSNRVVGADGSVDLTRCFVAVNLDDELVLNVCVSEGAGSIFELVLGHNDEECVREQGPYELQVNVVWTAAFKHRQRRKLFERIGDFRVLRGENYRKRSESVASLWKRCSIGRVSAERHQPPATPPPRCRAPSPSADAVPAARVGPGAEMSMNSRFLLCSQNDLHLGFRFVACNVFIWTDAGAQSIACLDVGSIEEAPCICARWPFCEQSAPSVPFWCGLSRPSTASSLVPTGHPLCN

SEQ ID NO: 1322 - protein, 750 aa, Oryza sativa
MRNICQRNRLKKKIPFHSLPHHLNKKLYVMILEKAMKTLMTILISMMEKAMKTLMTMLILMMKAMKILMLILMFEATAKFNSPNVENGAPETRGKTKLKDVWNLPKGLRIVVQCNDLNQAVGEEAGVLGKFLGMIARNGSLCSLGYTDWRYVIGKREKNTNELKVKKDILKQVKMRFLYAPRMEEFILKKIGERWRQYKAKLKDLYFDVNETKEANCNNVPEGVLSDQWIALVNHWMNEKSKRISEQNKKNCQKKKAIHTAGTKSFARTREEMRQKDPAKKYPHRAVVYVHTHKRKSDKNINGHVDNLKRLIAEQPALADASKGKTAWKGDALNQILGDDKPGRVHGLGLVPKPKQVLDVPTSRRLQNINLTTVEDNSSEDVMAIRLQMEKLERHVENNDAELLQLKEKATKLEKAQKNQGGLDGASTNKKAICDDVPNSKRRRVYGDNPSQEICMFEEGNIMDQQDNSLMNTQSHVHDENLQPPTKHSTVYKRKGNLDQNELMQPGKSISSAYKNNKPDNQDNYMVNAHKVTSTHKNKENLTRKLVRPSLNKYSTASKKRQCNTMDFLTDNSTVKVYGDGPLQEICHVEQENIVMNSQSHAQDEDKTPPTKHATAHKNKRTFGLNDHGKQMEIICAKEQQCSKMDFITDNSMEVGTKVFLKSWKNRNTNVALATIVSCDPTRRVGGVELGNEFLMVHVDLALAKSEDLIRPYKGYKIVGHVVGLEIAWPAIFICSYLLLLTSEMCFSSS

SEQ ID NO: 1323 - protein, 130 aa, Oryza sativa
MESCPSVKNILVLDSEGKRVAVKYYSDDWPSLSSKQAFEKSVFAKTQKTSARTEAEIVMFDSYFVVYKFIQDLHFFVTGGDEENELILASVLQGFSEAIDYLLRNKVHRRAALENLDLIFLCLDEVVDGG

SEQ ID NO: 1324 - protein, 261 aa, Oryza sativa
MGRLRRGGVGLLRGAVVLASLLLVVSGEVIFEERFDDDWGSRWVKSDWKKSEGKAGTFKHTAGSYSGDPDDRGIQTTSDAKHFAISAKFPEFSNKNRTLVVQYSIKIEQDIECGGAYIKLMSGYVNQKKFGGDTPYSFMFGPDICGDQTKKLHLILSYQGQNYPIKKDLKCETDKLTHFYTFILRPDASYSLLVDNREREFGSMYTDWDILPPRKIKESNAKKPKDWDDREYIEDPDEVKPEGYDSIPKEIPDPKDKKVCT

SEQ ID NO: 1325 - protein, 341 aa, Oryza sativa
AGKRSVYLMDCAPVWGCASTRGRSAEMEDASAAVPRFADVPVRLLASRRDLDALGLDADALRLPAHLFGVFDGHGGAEVANYCRERIHVVLSEELKRLGKNLGEMGEVDMKEHWDDVFTKCFQRVDDEVSGRVTRVVNGGGEVRSEPVTAENVGSTAVVALVCSSHVVVANCGDSRIVLCRGKEPVALSIDHKPDRKDERARIEAQGGKVIQWNGYRVSGILAMSRSIGDRYLKPFVIPKPEVMVVPRAKDDDCLILASDGLWDVVSNEEACKVARRQILLWHKNNGAASPLSDEGEGSTDPAAQAAADYLMRLALKKGSEDNITVIVVDLKPRKKLKNIS

SEQ ID NO: 1326 - protein, 90 aa, Oryza sativa
MGSRSGGRHRLFLRFIALWSLLLIAAGEVIFEERFEDGWESRWVKSDWKRSEGKAGTFKHTAGRYSGDPDDKDNVGRQAFCYIGQDPRIQ

SEQ ID NO: 1327 - protein, 413 aa, Oryza sativa
MEAAELVKKIRELEEGQAELKREISRIVPERGGARRPPTLPAQQRRTALPQAAAAAPSSRLLQRVGRAGLPDRHYVRILHSLGQAVHVISLDGKLMYWNRYAEHLYGYSVPEAVGQDALELIVHPSDYGAANDIIQNIFMGKCWRGKFPVKHKSGERFNIVASNTPLYDDDGSLVGLICLSTDTRTLEEILGHSTSGKVYPSSAKPRVQLNGSKSGLLNKVSCDSQQPLQSAITSRITNLSNKHRLPGLQIEFALGSRRVRIAMISSVVPVRAIILNMMPEKSRHLVKEAPQVGMFFMGPLLVKTITLGSQAKQTVMTQEKENWGFTKFLAQQQRHCGPTGEFHGLGEVMEMMMLGRIERTCHSSMKFKRMDRAIRKFQSQSYYQTAKILNLSRKSNMRFQVPGGLSMPAQVV

SEQ ID NO: 1328 - protein, 49 aa, Secale cereale
FEIDQEWDDKEDGNEAVQQWEDDWDDDDVNDDFSLQLRKELEGGNTQKS

SEQ ID NO: 1329 - protein, 226 aa, Secale cereale
  misc_feature (44)..(44): Xaa can be any naturally occurring amino acid
  misc_feature (220)..(220): Xaa can be any naturally occurring amino acid
DGGAADVGAGEGRERAGRHAHLRALREVLLPRPRRPHLPQAQKXGQQTQEEVQKRNLRDELEERERKHFSSKDKSYVDDRDRRKSSSLLLEGSKRDEDKIVPREIDADDSDVELKSDDESDDDDDDDDTEALMAELERIKKERAEDRLRKERQQAEEEAKMKEAELMRGNPLINMNNSGSFNVKRRWDDDVVFKNQARGETKTPKRFINDTIRSDFHRKXLHRYMK

SEQ ID NO: 1330 - protein, 406 aa, Carthamus tinctorius
MTSRKMLIDGDVGENTEDIQYDFDLFVIGAGSGGVRASRFSAQYGAKVGICELPFHPVSSEVIGGVGGTCVIRGCVPKKILVYGASFGPEIQDSREYGWQVNEKIDFDWKKLLHKKTEEILRLNGIYKRLLSNAGVKLFEGEGRIVGPNEVEVIQLDGTKLSYTAKHILIATGSRAARVAIPGQELAITSDEALSLEELPKRVVILGGGYIAVEFASIWRGMGSTVNLCFRKELPLRGFDDEMRALVARNLEGRGIILHPQTNLTELVKTEDGIKVTTDHGEELMADAVLFATGRLPNTKRLNLQAVGVEVDSAGAVKVDEFSRTNVPSIWAIGDATNRMNLTPVALMEGTLFAKTVFGNEPSKPDYSNIPCAVFCIPPLSVVGVSEEEAIEKAQGDILVFTSTFN

SEQ ID NO: 1331 - protein, 268 aa, Carthamus tinctorius
MSNHGVGRSSSLSLIFGALLFVLVSICDFSCSEIIFEERFGDGWQSRWVKSDWKRSEGKAGSFKHTAGSWSGDPDDKGIQTSTDARHFAISAKIPEFNNKNRTLVLQYSIKIEQDIECGGGYIKLMSGYVNQKKFGGDTPYSVMFGPDLCGTQTKKLHVILSYQGQNYPIKKDLQCETDKLTHFYTFILRPDASYSILIDGRERDSGSMYTDWDILPPRKIKDVKAKKPADWEEREYIEDPDQVKPEGYDSIPREIPDPKAKQPDTWD

SEQ ID NO: 1332 - protein, 77 aa, Carthamus tinctorius
MATTEQQPKAAATEEAKIDLFEDDDEFEEFEIDQDWDVKEEGKEVTQQWEDDWDDDDVNDDFSLQLRKELESNTEKK

SEQ ID NO: 1333 - protein, 277 aa, Carthamus tinctorius
  misc_feature (240)..(240): Xaa can be any naturally occurring amino acid
HTSSASSCGSTNSSAINKVDMDTDSLDYEILWEDLIIGEQIGQGSCGTVYHAMWYGSDVAVKVFSRQEYSEDVILSFRQEVSLMKRLRHPNILLFMGAVTSPQRLCIVTEFLPRGSLFRLLQRNTTRLDWRRRVHMAMDIARGMNYLHHCHPPIIHRDLKSSNLLVDKNWNVKVGDFGLSRIKHETYLTTKTGKGTPQWMAPEVLRNEQADEKSDVYSFGVVLWEITTEKIPWDSLNSMXVIGAVGFMNQRLDIPKDVNPQMAELIESCCCSEPASR

SEQ ID NO: 1334 - protein, 222 aa, Carthamus tinctorius
MSFQDIEAGRPLNSRRGGGLNNGIRKQDPTQAVASGIFQINTAVSTFQRLVNTLGTPKDTPELREKLHKTRLHIGQLVKDTSEKLKQASETDHRADVSASKKITDAKLAKDFQAVLKEFQKAQRLSAERETAYTPFVPQAAYPSSDPANEMDASSGKSQEQRALLVDNKRQEVLLLDNEIAFNEAIIEERDQGIQEIQNQIGEVNEIFKDPAVLVHEQGTMI

SEQ ID NO: 1335 - protein, 275 aa, Carthamus tinctorius
MSFQDLEAGRPLNSKRVGYVNGGRQQDPTQAIASGIFQINTAVSTFQRLVNTLGTPKDTPELREKLHKTRLHIGQLVKDTSDKLKQASEADHRSQVSASKKITDAKLAKDFQAVLKEFQKAQRLSAERETAYTPFTPQAVLPSSYAASEMDVSSNKGQEQHALLMETRQEVLLLDNEIAFNEAIIEEREQGIQDIQNQIGEVNEIFKDLAVLVHEQGAMIDDIGSNIENSHAATAQARVQLSKASKTQRANSSMTCLLLVIVGIVLLIVIIILAV

SEQ ID NO: 1336 - protein, 94 aa, Carthamus tinctorius
SSNPSFIGTSFWILVFVRMATTEQPKVAATEEAKIDLFEDDDEFEEFEIDHEWDVKEEGKEVSQQWEDDWDDDDVNDDFSLQLRRELESNTEKK

SEQ ID NO: 1337 - protein, 228 aa, Sorghum bicolor
MAPAKSGEKATSFAMACSLLSRYVRQNGAAAGDLGLAIRAEADGKRASADTEKGDTTKETMDLFPQNAGFGSEAAMKEAPDVREPEKRQLTIFYGGKVLVFNDFPAEKAKDLMQMASKGSSVAQNPGMLPSPTVATVTDSTKITAVPAAPIAVVNAQKSPADIPQAPKASLRRFLEKRKDRLTAKAPYQGSPSDATPVKKEMAEGQPWLGLGPQIANPDLSLCKEGSQ

SEQ ID NO: 1338 - protein, 557 aa, Sorghum bicolor
MDDDFEMPTAGADEMMGDDEMGDFGGDEGPVLKVGEEKEVGKQGLKKKLLKEGEGWETPEVGDEVEVHYTGTLLDGTKFDSSRDRGDPFKFKLGQGQVIKGWDQGIKTMKKGENAVFTIPPELAYGASGSPPTIPPNATLQFDVELLSWTSVKDICKDGGIFKKILKEGEKWENPKDPDEVLVKYEARLEDGTVVSKSEGVEFTVKDGYFCPALAKAVKTMKKAEKVLLTVKPQYGFGEKGRPAAGEEGGVPPNATLHIDLELVSWKTVTEIGDDKKILKKVLKEGEGYERPNEGAVVEVKITGKLQDGTVFTKKGHDEEPFKFKTDEEEVIDGLDRAVLNMKKGEVALVTIPPEYAFGSTESKQDLAVVPPNSTVVYEVELVSFVKDKESWDLNNEEKIEAAGKKKEEGNALFKLGKYARASKRYEKAAKYIEYESSFSEDEKKQSKQLKISCNLNNAACKLKLKDYKEAAKLCTKVLELDSQNVKALYRRVQAYIQLADLELAEADIKKALEIDPNNRDVKLEYKTLKEKIKEYNKKDAKFYSNMFAKMTKWLLG

SEQ ID NO: 1339 - protein, 359 aa, Sorghum bicolor
MIEGAGSLVDAHTVEVSQPDGSKQRYTAKHILIATGSHAQRVNIPGKELAITSDEALSLEELPKRAVILGGGYIAVEFASIWRGMGAEVDLFYRRELPLRGFDDEMRTVVASNLEGRGIKLHPGTNLSELSKTADGIKVVTDKGEELIADVVLFATGRTPNSQRLNLQAAGVEVDQIGAIKVDEYSRTSAPSVWAVGDVTNRINLTPVALMEATCFAKTVFGGQEVKPDYGDVPCAVFSIPPLSVVGLSEQQALEEANGDILVFTSSFNPMKNSISKRQEKTVMKLVVDAETDRVLGASMCGPDAPEIIQGIAIALKCGATKANFDSTVGIHPSAAEEFVTMRTVTRRVSPTSKPKTNL

SEQ ID NO: 1340 - protein, 231 aa, Sorghum bicolor
MTTAARPTWAPAKGGNEQGGTRIFGPSQKYSSRDLAAHTSLKPRKDGQQTQEELQKRNLREELEERERKHYSSKDKSYSEERDRRKSSSQLLLEGSKREAEDKIVPREIDADDSDVEPKSDDESDEDDDDDDDTEALMAELERIKKERAEEKLRKERQQAEEEAKMKEAELMRGNPLININNPGSFSVKRRWDDDVVFKNQARGETKTPKRFINDTIRSDFHRKFLQRYMK

SEQ ID NO: 1341 - protein, 251 aa, Sorghum bicolor
MEGFWDAQSQRRRTGGGGGFESLKRLGHISPAVQSHLKHVYLTLCSALVFSALGAYLHILLNVGGTLTTVGCLAAIAYLISLPASRDQERNRFALLMSAALLQGASVGPLVDLVIDFDPRILATAFVGTAIAFGCFSGAAIIANRREYLYLGGLLSSGLSILLWLQFATSIFGHTSTTFMIELYFGLLVFLGYMVFDTQEIIERAHGGDMDYIKHALTLFTDFVAVLVRILVIMMKNAQEKSEDEKKRKKR

SEQ ID NO: 1342 - protein, 231 aa, Sorghum bicolor
MNIFKKKVDPKEALRTSKREMAVATRGVEREIGSLQMEEKKLVAEIKKTAKTGNEAATKILARQLVRLRQQILNLQGTRAQIRGVATHTQAMYAGTSISAGMKGASKAMAAMNKQMEPVKQIKVMKEFQKQSTQLDMTLEMMSDAIDETLDKDEAEEETEELTNQVLDEIGVDVASQLSSAPKGRIGATNKKVDNSHARNPAAPARNVAAPPESSAEVDDLERRLASLRRI

SEQ ID NO: 1343 - protein, 133 aa, Sorghum bicolor
MTTAARPTWAPAKGGNEQGGTRIFGPSQKYSSRDLAAHTSLKPRKDGQQTQEELQKRNLREELEERERKHYSSKDKSYAEERDRRKSSSQLLLEGSKREAEDKIVPREIDADDSDVEPKSDDERMTMMMTLKL

SEQ ID NO: 1344 - protein, 186 aa, Sorghum bicolor
MTTAARPTWAPAKGGNEQGGTRIFGPSQKYSSRDLAAHTSLKPRKDGQQTQEELQKRNLREELEERERKHYSSKDKSYAEERDRRKSSSQLLLEGSKREAEDKIVPREIDADDSDVEPKSDDESDDDDDDDDDTEALMAELERIKKERAEEKLRKERQQAEEEAKMKEAELMRGNPLISINHPGSF

SEQ ID NO: 1345 - protein, 408 aa, Sorghum bicolor
MGTRRGSGVLHRLLALSSLLLLASGEIVFEERFEDGWESRWVESDWKRSEGKAGRFKHTAGRYSADPDDKGIQTTMDARHFAISAKFPQFSNKNRTLVVQYSIKFEQDIECGGGYIKLMSGYVNQKKFSGDTPYSLMFGPDICGTQTKKLHLIVSYQGQNYPIKKDLECETDKLTHFYTFILRPDASYSLLVDNRERETGSMYTDWDILPPRKIKDLHAKRPKDWDDREYIEDPDEVKPEGYDSIPKQIPDPKAKKPDTWDEDEDGIWKPRMVSNPAYKGPWKRKRIKNPNYKGKWKTPWIDNPEFEDDPDLYVLKPLKYIGIEVWQVKAGSVFDNILICDDPEYARNVVEETWGANREAEKEAFEEAEKERKAREDREGQKAKDDGGRRRPRKKHYRDHWDDYHDEL

SEQ ID NO: 1346 - protein, 109 aa, Sorghum bicolor
METCPSVKNILLLDSEGKRVAVKYYSDDWPTLSAKLAFEKSVFAKTQKANAGTEAEIVMFDGQIVVYKFIQDLHFFVTGGEEENELILASVLQGFSDAVERLLKLLPLY

SEQ ID NO: 1347 - protein, 626 aa, Sorghum bicolor
MDSSGEELLKKIRELEVGQAQLKQEMSKLIPGAGERRRSQSVSPRRGAPVPPPPPAKGKAGAPGRRLSGGFEGGQRAWARGSASFPHSSPLQREGRAAGAGDASTSARLPERQYSRVLQSLGQSVHILDLDGRIIYWNQSAENLFGYPASEALGQDALMLLVDSHDHNAVNDIFRRISMGESWTGKFPVKNRQGDRFSALATNTPFYDEDGSLVGIICVSSDSRLLEQIFCKPPTSARPQSESSRTSCDGSCSNTSRRINLLNKSPFDPQLPLQSTLASKITNLATKVTNKVRSRVRTDENGIEREGGSGESHCSDRGAKEEPTSSGTNTPRGDAPHGPFATEENSPGKSMNPNSDESEGKIALHKIWSTKAEALLNKKGISWPWKGRENEGPDERNHVILPWLHGDQENGTNHQKVSDSSIVPDAQGAEHNQPNKNEASGSWSSFNNNSTSSASSTGSTNSSALYKVDHEADCLDYEILWEDLVIGEQIGQGSCGTVYHALWYGSDVAVKVFSKQEYSEEVILTFRQEVSLMKKLRHPNILLFMGAVTSPQRLCIVTEYLPRYVPTFLQAYMFASVCYSVAFPHVAHLLELSQKVCLHLIEWFDYNNSCIRKRKIKFRNSRLCLS

SEQ ID NO: 1348 - protein, 246 aa, Sorghum bicolor
MGSSEADEDQLLKSFLAEVSEAERDNEVLRILGCFKLNPFEHLKLSFDSSPDEVKKQYRKLSLLVHPDKCKHPQAQEAFAALAKAQQLLLDPQERGYILDQVTAAKEELRAKRKKELKKDSASKIKSLVDEGKYEEQFERSDEFQQQLIIKVREILTDKEWRRRKMQMRISEEEGRLKKDEEETKEMWKRKREHEEKWEETRDQRVSSWRDFMKTGKKGRKGEIKPPKLKTEDPNKSYVQRPVKRN

SEQ ID NO: 1349 - protein, 208 aa, Sorghum bicolor
MAASSLCHGHLLLFLLVAVASACLGTAAAHQAGSGEGYTIAGRVKIDGASAKGFGLPAKTSNTKVILNGGQRVTFARPDGYFAFHNVPAGTHLIEVSSIGYFFSPVRVDISARNPGYIQAALTETRRVLNELVLEPLKEEQYYEVREPFSVMSLLKSPMGLMVGFMVLMVFVMPKLMENIDPEEMKQAQEQMRNNPVSFSGLLSRAQG

SEQ ID NO: 1350 - protein, 420 aa, Sorghum bicolor
MGRLRDGRAFLHRALVLSSLLLLASGEIFFEERFDDGWDSRWVKSDWKKSQGQTGTFRHTAGTYSGDPDDKGIQTTGDAKHFAISAKFPEFSNKDRTLVIQYSLKIEQDIECGGAYIKLMSGYLNQKKFGGDTPYSFMFGPDICGDQKKKLHLILSYQGQNYPIKKDLKCEADKLTHFYTFILRPDATYSILIDNREREFGSMYTDWDILPPRKIKDVNAKKPKDWDDREYIEDPDQVKPEGYDSIPKQIPNPKDKKPESWDDDEDGTWKPRMIPNPEYKGPWKRKKIKNPNYKGKWKTPWIDNPEFEDDPDLYVLKPLQYVGIEVWQVKAGSVFDNILICDDPDYARHVVDETFAANKEAEKEAFEGAERKRKAREEEEARRAREEGERRRRERDRDRGRDRYRDRYKRHRHYDYHDEL

SEQ ID NO: 1351 - protein, 374 aa, Sorghum bicolor
RARPLQLLFLSLHTLLSASPPLPSPTSTMATAAAATAASTSLLAPAASSTAPGASPNALFFPSSVPSLRAYPRLLLAFRRPAAAAAQGAVLEEEEVQADQRGQYDDDDDGYEGGRGPAFTAPTRPRTGKAALPLKRDRTRSKRFLEIQKLRESKKDYDVPTAISLMKQMSSAKFVESAEAHFRMNLDPKYNDQQLRATVNLPKGTGQSVKIAVLTQGEKIDEARAAGADIVGGEDLIEQIKGGFMEFDKLIASPDMMPKVAGLGKILGPRGLMPNPKAGTVSPNITQAIEEFKKGKVEYRVDKSGIVHIPFGKVDFPEEDLIANFMAVVRSVERNKPSGAKGIYWKTAYLCSSMGPSIKLNIKEMLDYGLDSSD

SEQ ID NO: 1352 - protein, 204 aa, Sorghum bicolor
ALWDLRMVVASILFKGLKEFQGLNLCLMQETCPSVKNILLLDSEGKRVAVKYYSDDWPTLSAKLAFEKSVFAKTQKANAGTEAEIVMFDGQIVVYKFIQDLHFFVTGGEEENELILASVLQGFSDAVERLLKNMVDKRTALENLDLILLCLDEIVDGGIVLETEGREIAEKVSGHGLEGASSAEQTLVNALTQAREHFAKSLLM

SEQ ID NO: 1353 - protein, 553 aa, Sorghum bicolor
MDDDFEMPTAGADEMMGDDEMGDFGGDEGPVLKVGEEKEVGKQGLKKKLLKEGEGWETPEVGDEVEVHYTGTLLDGTKFDSSRDRGDPFKFKLGQGQVIKGWDQGIKTMKKGENAVFTIPPELAYGASGSPPTIPPNATLQFDVELLSWTSVKDICKDGGIFKKILKEGEKWENPKDPDEVLVKYEARLEDGTVVSKSEGVEFTVKDGYFCPALAKAVKTMKKAEKVLLTVKPQYGFGEKGRPAAGEEGGVPPNATLHIDLELVSWKTVTEIGDDKKILKKVLKEGEGYERPNEGAVVEVKITGKLQDGTVFTKKGHDEEPFKFKTDEEEVIDGLDRAVLNMKKGEVALVTIPPEYAFGSTESKQDLAVVPPNSTVVYEVELVSFVKDKESWDLNNEEKIEAAGKKKEEGNALFKLGKYARASKRYEKAAKYIEYESSFSEDEKKQSKQLKISCNLNNAACKLKLKDYKEAAKLCTKVLELDSQNVKALYRRVQAYIQLADLELAEADIKKALEIDPNNRDVKLEYKTLKEKIKEYNKKDAKFYSNMFAKMTK

SEQ ID NO: 1354 - protein, 627 aa, Sorghum bicolor
MGSRSAASAALRIWLLVSVALLLGCCQGRFVVEKNSLKVTAPDDLKGTYECAIGNFGVPQYGGTMVGFVAYPKANRKACKSFDDFDISYKAKPGAFPTFLLVDRGDCYFAKKAWNAQKAGAAAILVADDKDEPLITMDNPEESGNTDYLENITIPSALITKSFGDRLKKAIDKGDMVNVNLDWREALPHPDERVEYEFWTNSNDECGPKCDSQIDFVKSFKGAAQVLEKKGYTEFTPHYITWYCPEAFILSKQCKSQCINHGRYCAPDPEQDFSKGYDGKDVVVQNLRQVCVFKVAKEHKKPWLWWDYVTDFAIRCPMKEKKYTKECAEGVIKSLGLDHKAIDKCIGDPDADEENPVLKAEQDAQIGKGSRGDVTILPTLVINNRQYRGKLDKGAVLKALCAGFKETTEPAVCLSEDIQTNECLENNGGCWQDKAANITACKDTFRGRVCECPVVKGVKFVGDGYTHCEASGSGRCEINNGGCWKDTKNGRTYSACTDDGCKCPDGFKGDGKHKCEDIDECKEKTACQCKECKCKNTWGSYECGCSGGLLYMREHDTCISKNGGSEAGWGFLWVVFFGLVAAGIAGYAVYKYRIRRYMDSEIRAIMAQYMPLDNQGDVQSHSHHIEM

SEQ ID NO: 1355 - protein, 590 aa, Sorghum bicolor
MAEAEAEAAPAAAAGGGGIGDILATAERDFLVRNSGEQVKISSIEASPVAIYFSASWCPPCRRFTPKLIEVYKELAEQGKSFEVIFASADQNEEGFNEYFAKMPWLAVPFSDTEGRAALDARFKVSGIPHLVILDAKTGEVYTEDGVEFVSEYGVEAYPFTPDRINELKEQEKAEKENQTIQSVLGTSTRDYLISNKGDKVPISELEGKYVGLCFVVDGYGPVIEFTDSLAKIYEKLKEVGEKFEVVAVSLDSEESAFNESFAKMPWLAIPQGDQKCEKLVRYFELRSLPTLVLIGPDGKTLNSNVADIIDEHGFEAWEGFPFSAEKLEILAEKAKAKAASQTLESLLISGDLDFVIGKGGAKVPVSELVGKTVLLYFSAKWCGPCRAFLPTLVKEYNKIKEKNSDFEIVFISSDRDQSSFDDFFSQMPWLALPLEDERKVSLKKTFKIRGIPSLVAIGPTGQTVSRDAKAQLMIHGADAFPFTEERLEELQKKLDEMAKGWPQKLKHELHDEHELVLLRRGTYGCDGCEEMGSTWSYRCDECDFDLHPKCALAEEKKVRKPLLGMCARKACAGRSRFVLLSCLCVSGAI

SEQ ID NO: 1356 - protein, 259 aa, Sorghum bicolor
LLAVSEPRGRGEGQPDRPTASSPSSSPLLSSRVRSFPCRLGFADDDGGTRIFGPSQKYSSRDLAAHTSLKPRKDGQQTQEELQKRNLREELEERERKHYSSKDKSYSEERDRRKSSSQLLLEGSKREAEDKIVPREIDADDSDVEPKSDDESDEDDDDDDDTEALMAELERIKKERAEEKLRKERQQAEEEAKMKEAELMRGNPLININNPGSFSVKRRWDDDVVFKNQARGETKTPKRFINDTIRSDFHRKFLQRYMK

SEQ ID NO: 1357 - protein, 176 aa, Sorghum bicolor
METCPSVKNILLLDSEGKRVAVKYYSDDWPTLSAKLAFEKSVFAKTQKANAGTEAEIVMFDGQIVVYKFIQDLHFFVTGGEEENELILASVLQGFSDAVERLLKNMVDKRTALENLDLILLCLDEIVDGGIVLETEGREIAEKVSGHGLEGASSAEQTLVNALTQAREHFAKSLLM

SEQ ID NO: 1358 - protein, 495 aa, Sorghum bicolor
MARKMLVDGEVAAVADAGQYDYDLFVIGAGSGGVRGSRFAASFGAKVAICELPFHPISSEWLGGHGGTCVIRGCVPKKILVYGASFGGEFEDSKNFGWEINGDINFNWKKLLENKTKEIVRLNGVYQRILTNAGVTMIEGAGSLVDAHTVEVSQPDGSKQRYTAKHILIATGSHAQRVNIPGKELAITSDEALSLEELPKRAVILGGGYIAVEFASIWRGMGAEVDLFYRRELPLRGFDDEMRTVVASNLEGRGIKLHPGTNLSELSKTADGIKVVTDKGEELIADVVLFATGRTPNSQRLNLQAAGVEVDQIGAIKVDEYSRTSAPSVWAVGDVTNRINLTPVALMEATCFAKTVFGGQEVKPDYGDVPCAVFSIPPLSVVGLSEQQALEEANGDILVFTSSFNPMKNSISKRQEKTVMKLVVDAETDRVLGASMCGPDAPEIIQGIAIALKCGATKANFDSTVGIHPSAAEEFVTMRTVTRRVSPTSKPKTNL

SEQ ID NO: 1359 - protein, 135 aa, Sorghum bicolor
METCPSVKNILLLDSEGKRVAVKYYSDDWPTLSAKLAFEKSVFAKTQKANAGTEAEIVMFDGQIVVYKFIQDLHFFVTGGEEENELILASVLQGFSDAVERLLKNMVDKRTALENLDLILLCLDEIVDGGRKRDS

SEQ ID NO: 1360 - protein, 604 aa, Sorghum bicolor
MAEAEAEAAPAAAAGGGGIGDILATAERDFLVRNSGEQVKISSIEASPVAIYFSASWCPPCRRFTPKLIEVYKELAEQGKSFEVIFASADQNEEGFNEYFAKMPWLAVPFSDTEGRAALDARFKVSGIPHLVILDAKTGEVYTEDGVEFVSEYGVEAYPFTPDRINELKEQEKAEKENQTIQSVLGTSTRDYLISNKGDKVPISELEGKYVGLCFVVDGYGPVIEFTDSLAKIYEKLKEVGEKFEVVAVSLDSEESAFNESFAKMPWLAIPQGDQKCEKLVRYFELRSLPTLVLIGPDGKTLNSNVADIIDEHGFEAWEGFPFSAEKLEILAEKAKAKAASQTLESLLISGDLDFVIGKGGAKVPVSELVGKTVLLYFSAKWCGPCRAFLPTLVKEYNKIKEKNSDFEIVFISSDRDQSSFDDFFSQMPWLALPLEDERKVSLKKTFKIRGIPSLVAIGPTGQTVSRDAKAQLMIHGADAFPFTEERLEELQKKLDEMAKGWPQKLKHELHDEHELVLLRRGTYGCDGCEEMGSTWSYRCDECDFDLHPKCALAEEKKVRKPLLGMCARKACAGRCYLNGVRDDNNREMVVLGAEVFELLMFVC

SEQ ID NO: 1361 - protein, 623 aa, Sorghum bicolor
SLSYSLLPAPASSSCSLKEGGGEGRGAMSEQQPLPQPRSSMREALEKEDKEKAAAAAAKEKAAVPKNGGNGGGGKNGGGGNGGGVGGGNGGGAPPSGEETAREIQVVREAYRRETAAPAYVIPEEPPAMVELVGWYIYGFCSYFITHLLLPVLFPAIITQVAFPNSDFTPDPKYTLKGVTCSVHEMSMYQRLTKHSIVIDDSRMSPLGWSGLSWAIGILIVAPLLTQTAHHLDRGQYQSLILIAATSFGSFFCLLTGFFKTVWVFLFYILFIAGSIIIAEAVHTRNLGLMIRGLAAHDSGKHLVLRRRAAASQLSLYCTAIGGIGAALMAAFMYHMLRRTDQLTGLWVVSIFCGLIWFIGICHGLFTNRPSSSSPTTAFEPNFFTKLSYSMTLLRYPQAIGSLVAVFLSSFATMCIFTSGTLYAIGGVCIKPVLVLVLWILYFLFPLISLPLLHPIQIIIRADAVRMQLLGFIICLFVSGAGFYFKSHRWRAAHIIVIALVQSTANGILYAFGRILLLDASPPGKEGAFSVWYAFVRVTGAMIGFAASSAGPGRAGGSFAAAFLGSFLGIIVLIFGNVSNIGALKAAGHLKGMDDEKRMGGLGEKGEGMGSAVADSGESRGRV

SEQ ID NO: 1362 - protein, 77 aa, Sorghum bicolor
MAAAPAPADAKAEAAKMDLLEDDDEFEEFEIDQEWDDNEEGNEAVQQWEDDWDDDDVNDDFSLQLRKELEGNNAQKS

SEQ ID NO: 1363 - protein, 569 aa, Sorghum bicolor
LLVFVLICGRLVSGWVIRIAVFGVERNFLLRKRVLYFVYGVRSAVQNALWLGLVLASWHFLFDKNVQQETNSAVLPYVTKILFCFLVATLIRLVKTLLVKVLASSFHVSTYFDRIQEALFNQYVIETLSGPPLVDENHVLEEVHELQRAGATIPKELRDAVPTKHVSGQRNIQLSGVMPKGEGSKQLSKEKGEGISIDALHKLNQKNISAWNMKRLMRIVRFGTLTTMDEQIQQATGQGDESATQIRSEYEAKIAAKKIFHNVAKPGSKYIYLSDMMRFMRQEEAVKAMDLFEGAQEHNRVSKRSLKNWVVNAFRERKALALTLNDTKTAVNKLNQMANVVVGIIVFALWLLILGIATTHFFVFLSSQLLLAVFVFGNTLKTVFEAIVFLFVMHPFDVGDRCEIEGVQMVVEEMNIMTTVFLRYDNLKIYYPNSVLATKPIMNYYRSPDMGEAIDFSIHVATPVEKLALMKERLLRYIDNKKEHWYPGAMVVLRDVDDTNKLKVSIWLRHTLNWQDMGMRFVRRELVLQEMIKVLRDLEIEYRMLPLDVNVRNAPAIQSTRMPTTWSYS

SEQ ID NO: 1364 - protein, 618 aa, Sorghum bicolor
SLSYSLLPAPASSSCSLKEGGGEGRGAMSEQQPLPQPRSSMREALEKEDKEKAAAAAAKEKAAVPKNGGNGGGGKNGGGVGGGNGGGAPPSGEETAREIQVVREAYRRETAAPAYVIPEEPPAMVELVGWYIYGFCSYFITHLLLPVLFPAIITQVAFPNSDFTPDPKYTLKGVTCSVHEMSMYQRLTKHSIVIDDSRMSPLGWSGLSWAIGILIVAPLLTQTAHHLDRGQYQSLILIAATSFGSFFCLLTGFFKTVWVFLFYILFIAGSIIIAEAVHTRNLGLMIRGLAAHDSGKHLVLRRRAAASQLSLYCTAIGGIGAALMAAFMYHMLRRTDQLTGLWVVSIFCGLIWFIGICHGLFTNRPSSSSPTTAFEPNFFTKLSYSMTLLRYPQAIGSLVAVFLSSFATMCIFTSGTLYAIGGVCIKPVLVLVLWILYFLFPLISLPLLHPIQIIIRADAVRMQLLGFIICLFVSGAGFYFKSHRWRAAHIIVIALVQSTANGILYAFGRILLLDASPPGKEGAFSVWYAFVRVTGAMIGFAASSAGPGRAGGSFAAAFLGSFLGIIVLIFGNVSNIGALKAAGHLKGMDDEKRMGGLGEKGEGMGSAVADSGESRGRV

SEQ ID NO: 1365 - protein, 230 aa, Sorghum bicolor
MTTAARPTWAPAKGGNEQGGTRIFGPSQKYSSRDLAAHTSLKPRKDGQQTQEELQKRNLREELEERERKHYSSKDKSYAEERDRRKSSSQLLLEGSKREAEDKIVPREIDADDSDVEPKSDDESDDDDDDDDTEALMAELERIKKERAEEKLRKERQQAEEEAKMKEAELMRGNPLININNPSSFSVKRRWDDDVVFKNQARGETKTPKRFINDTIRSDFHRKFLQRYMK

SEQ ID NO: 1366 - protein, 272 aa, Sorghum bicolor
MAPRLLACFGRRGGGATASAPDDEGQQQEAAAAPGPVLVELFASQGCGASPEADAVAARLAQDSGDGDGAAVAVVVLAFHVDYWDYRGWKDPFASSAWTVRQKAYVEALRLDTLFTPQVVLQGRAHCVGTEHDALAQAVRDAPRYPAPAIKVTFQRPNPTTLQASFTGTLRSRVEGPGGASVLVALYESGLVTDCGRGENKGKSLLNDHVVRRLEKVAAVREGASAKKTVSGTVQFPLWDGFRATKCGLVLFVQNAALQVLGVQHFDLPDNV

SEQ ID NO: 1367 - protein, 360 aa, Sorghum bicolor
GAGYEGKDVVVENLRQLCVHRVANDTGRPWAWWDYVMDYKIRCSMKEKKYTKTCAEDVVTALGLDLKKVLECMGDPEADADNAVLSKEQEDQIGSGSRGDVTILPTLVINNVQYRGKLERTAVLRAVCAGFKEGTEPRVCLSHDIETNECLHRNGGCWRDEATNVTACQDTYRGRVCECPVVNGVRYEGDGYTDCKAIGPGRCALNHGGCWSETRGQQTFSACSETALTGCRCPSGFHGDGHKCEDLDECREKLACTCPGCQCKNTWGNYECKCKGNQLYIRGEDVCIANSMSKLGWFITIAAVACVVGIGVAGYVFYKYRLRSYMDSEIMSIMSQYMPLDSQNNENQPLRQHDSEALRH

SEQ ID NO: 1368 - protein, 95 aa, Sorghum bicolor
MTTAARPTWAPAKGGNEQGGTRIFGPSQKYSSRDLAAHTSLKPRKDGQQTQEELQKRNLREELEERERKHYSSKDKSYSGTPTFSVSLFCFLPSG

SEQ ID NO: 1369 - protein, 228 aa, Glycine max
MTTAARPTWAPAKGGNEQGGTRIFGPSQKYSSRDIASHTTLKPRKEGQDTQDELKRRNLRDELEDRERRHFSSKNKSYDDRDHGKGSHLFLEGSKRDIEDRIVARSVDADDSDVEVKSDDDSDEDDDDEDDTEALLAELEQIKKERAEEKLRKERQQQEEELKVKEAELLRGNPLLNNPTASFNVKRRWDDDVVFKNQSRGETKTAKRFINDTIRNDFHRKFLHKYMK

SEQ ID NO: 1370 - protein, 237 aa, Glycine max
MANGNNISHFFKLLLFLLTFHSCLAEIFFQERFEDGWKSRWVLSDWKRSEGKAGTFKHTAGKWSGDPDDKGLQTYNDAKHFAISAKIPELSNKDRTLVVQYSIRFEQDIECGGGYIKLLSGYVNQKKFGGDTPYSLMFGPDLCGSQTKKLHLILSYQGQNYPIRKDLQCETDKLTHFYTFILRPDASYSILVDNRERDSGSMYMDWDILPPRKIKDVKAKKPSDWDDREYIEDPNDV

SEQ ID NO: 1371 - protein, 273 aa, Glycine max
MSFQDIEAGRSFASRRNLINGKQDPTQAVASGIFQINTAVSTFQRLVNTLGTPKDTPELRDKLHKTRLHIGQLVKDTSAKLKQASEIDHNVEVNASKKIADAKLAKDFQAVLKEFQKAQRLSAERETAYTPFVPQALLPSSYTASEVDIGSDKTPEQRALLVESRRQEVLFLDNEISFNEAIIEEREQGIQEIQSQIGEVNEIFKDLAVLVHEQGAMIDDIGSNIEHSHEATAQAKSQLAKASKTQRSNSSLTCLLLVIFGIVLLIVIIVLAA

SEQ ID NO: 1372 - protein, 210 aa, Glycine max
LQNEGAGGESLLGSIKIAVMPIVKVFTMCSLGLLMASKYVNILPASGRKLLNGLVFTLLLPCLIFSQLGQAVTLEKMLAWWFIPMNVVLSSIAGSLIGFVVATIVRPPYPFFKFTIVQIGIGNIGNVPLVLISALCRDQSNPFGDMEKCSTDGTAYISFGQWVGAIILYTYVFQMLAPPPEGSFEIDNESVPLKSTPMSDATPEQAPLLA

SEQ ID NO: 1373 - protein, 228 aa, Glycine max
MTTAARPTWAPAKGGNEQGGTRIFGPSQKYSSRDIASHTTLKPRKEGQDTQDELKRRNLRDELEDRERRHFSSKNKSYDDRDHGKGSHLFLEGSKREMEDHIVPRSVDADDSDVEVKSDDDSDDDEDDEDDTEALLAELEQIKKERTEEKLRKERQQQEEELKVKEAELLRGNPLLNNPTASFNVKRRWDDDVVFKNQARGETKTAKRFINDTIRNDFHRKFLQKYMK

SEQ ID NO: 1374 - protein, 234 aa, Glycine max
MAENGSIELNKFVLFCLLLLIQVAVSEIIFEERFDDGWRSRWVKSDWKSSEGKAGSFKHTAGKWAGDPDDKGIQTSSDAKHFAISAKIPEFTNKNRTLVLQYSVKFEQEIECGGGYIKLLSGFVNQKKFGGDTPYILMFGPDLCGTDTKKLHVILSYHGQNYPIKKDLQCETDRLTHFYTFILRPDATYSVLVDNRERDSGSMYTDWDILPPRKIKDVKAKKPADWEEREYIED

SEQ ID NO: 1375 - protein, 273 aa, Glycine max
MSFQDIEAGRPFGSRRGLMNGKQDPTQAVAAGIFQINTAVSTFQRLVNTLGTPKDTLDLREKLHKTRLHIGQLVKDTSAKLKQASDIDHHAEVNASKKIADAKLAKDFQAVLKEFQKAQRLAAERETAYTPFVPQAVLPSSYTASEVDVGSDKSPEQRALLVESRRQEVLFLDNEIAFNEAIIEEREQGIQEIQQQIGEVNEIFKDLAVLVHEQGAMIDDIGSNIENSHAATAQAKSQLSKASKTQRSNSSLTCLLLVIFGIVLLIVIIVLAA

SEQ ID NO: 1376 - protein, 165 aa, Glycine max
MSFQDIEAGRSFAARRNLINGKQDPTQAVASGIFQINTAVSTFQRLVNTLGTPKDTPELRDKLHKTRLHIGQLVKDTSAKLKQASEIDHNVEVNTSKKIADAKLAKDFQAVLKEFQKAQRLSAERETAYTPFVPQGALPSSYTASEVDISSDKTPEQRALLVESR

SEQ ID NO: 1377 - protein, 323 aa, Glycine max
MSSLAGPYIMLRNLLWATSKHDVYLMQNYSVMHWSALLQRSKEVLNVAKPIIPTLTHPGFLAQPVSRVQISTMTVKENLMVAGGFQGELICKNLKQPGVLFCGKITTDGNAITNAVDVYRNPAGSLRVITANNDSQLRVFDAENFASLGCFKYDWSVNNTSISPDGRLLAVLGDSTECLMADANSGKITGSLKGHLDYSFSSAWHPNGQILATGNQDKTCRLWDIRNLSQSMAVLKGRMGAIRALRFTSDGRFLAMAEPADFVHIFDSHSGYEQGQEIDLFGEIAGISFSPDTEALFVGIADRTYGSLLEFNRKRHYNYLDSF

SEQ ID NO: 1378 - protein, 253 aa, Glycine max
MANGNTSHRFKLLLFLLTLHSSFAEIFFEERFEDGWKSRWVLSDWKRSEGKAGTFKHTAGKWSGDPDDKGLQTYNDAKHFAISAKIPELSNKDRTLVLQYSIRFEQDIECGGGYIKLLSGYVNQKKFGGDTPYSLMFGPDICGSQTKKLHLILSYQGQNYPIRKDLQCETDKLTHFYTFILRPDASYSILVDNRERDSGSMYTDWDILPPRKIKDVKAKKPADWDDREYIEDPNDVKPEGYDSIPAEIPDPKA

SEQ ID NO: 1379 - protein, 230 aa, Glycine max
MKRLRHPNIILFMGAVTSPQHLCIVTEFLPRGSLFRLLQRNTSKIDWRRRVHMALDVARGVNYLHHCNPPIIHRDLKSSNILVDKNWTVKVGDFGLSRLKHETYLTTKTGKGTPQWMAPEVLRNELSDEKSDVYSFGVILWELTTEKIPWDTLNPMQVVGAVGFMNHRLEIPEDVDPQWTSIIESCWHSDPACRPAFQELLERLKELQRRYTIEFQAARSAVEEGTQKEF

SEQ ID NO: 1380 - protein, 458 aa, Glycine max
VLLRIDWRESVPHPDNRVEYELWTNSNDECGARCDEQMNFVKNFKGHAQILERGGYTLFTPHYITWFCPPPFILSSQCKSQCINHGRYCAPDPEKDFGEGYEGKDVVYENLRQLCVHRVANESNRSWVWWDYVTDFHVRCSMKEKRYSKDCAEEVMKSLDLPVDKIKKCMGDPEADVENEVLKNEQQVQIGRGSRGDVTILPTLVINNVQYRGKLERTAVLKAVCSGFKETTEPSVCLSGDVETNECLERNGGCWQDKHANITACKDTFRGRVCECPVVNGVQYKGDGYTTCEAFGPARCSINNGGCWSETKKGLTFSACSDSKVNGCQCPVGFRGDGTNKCEDVDECKERSACQCDGCSCKNTWGSYDCKCKGNLLYIKEQDACIERSESKFGRFLAFVVIAVVVGAGLAGYVFYKYRLRSYMDSEIMAIMSQYMPLDQQNNVVHAETQPLRQQGTV

SEQ ID NO: 1381 - protein, 501 aa, Glycine max
MARKMLIDGEAELAQGGGEEVSNFDFDLFIIGAGSGGVRAARFSSNFGAKVGICELPFHPISSETIGGVGGTCVIRGCVPKKILVYGASFGGDLEDARNYGWELSEKVDFNWKKLLQKKTDEINRLNGLYKRMLSNWGVKLFEGEGKIVGPNEVEVTQLDGTKLSYTAKHILIATGSRAQRPNIPGQELGITSDEALSLEDLPKHAVVLGGGYIAVEFASIWRGMGSTVDLVFRKELPLRGFDDEMRAAVARNLEGRGINLHPRTNLTQLIKTEDGIKVITDHGEELIADAVLFATGRAPNSKRLNLETVGVELDNTGAIKVDEYSRTSIPSIWAVGDVTNRMNLTPVALMEASYFAKTVFGGQTIKPDYSNIPYAVFSIPPLSVVGLSEEQAIEQTNGDLLVFTSTFNPMKNTISGRQEKTVMKLVVDAETDKVLGASMCGPDAPEIMQGIAVALKCGATKAQFDSTVGIHPSAAEEFVTMRSVTRRVAGTGSVKPKTNL

SEQ ID NO: 1382 - protein, 501 aa, Glycine max
MARKMLIDGEAEIAQGGGEEVSNFDFDLFIIGAGSGGVRAARFSSNFGAKVGICELPFHPISSETIGGVGGTCVIRGCVPKKILVYGASFGGDLQDARNYGWELSEKVDFNWKRLLQKKTDEINRLNGLYKRMLSNWGVKLFEGEGKIVGPNEVEVTQLDGTKLSYSAKHILIATGGRAQRPNIPGQELGITSDEALSLEDLPKRAVVLGGGYIAVEFASIWRGMGSTVDLVFRKELPLRGFDDEMRAVVARNLEGRGINLHPRTNLTQLIKTEDGIKVITDHGEELIADVVLFATGRAPNSKRLNLEAVGVELDNTGAIKVDEYSCTSIPSIWAVGDVTNRMNLTPVALMEASYFAKTVFGGQKIKPDYNNIPYAVFSIPPLSVVGLSEEQAIEQTNGDLLVFTSIFNPMKNTISGRQEKTVMKLVVDAETDKVLGASMCGPDAPEIIQGIAIALQCGATKAQFDSTVGIHPSAAEEFVTMRSVTRRVAGTGSAKPKTNL

SEQ ID NO: 1383 - protein, 310 aa, Glycine max
GAVPPNATLQITLELVSWKTVSEVTDDKKVIKKILKEGEGYERPNEGAIVKVKLIGKLQDGTAFLKKGHDEEEKLFEFKTDEEQVVDGLDRAVLTMKKGEVALLTIAPDYAFGTSESQQELAVVPPNSTVYFEVELVSFEKEKESWDLNTEEKLEAAGKKKEEGNVLFKASKYARASKRYEKAVKYIEYDSSFGEEEKKQAKTLKVACNLNNAACKLKLKDYKEAEKLCTKVLDLESTNVKALYRRAQAHMQLTNLDLAELDIKKALDIDPNNRDVKLEYRTLKEKVKENNRKEAQFYGNMINKMTKIGS

SEQ ID NO: 1384 - protein, 317 aa, Glycine max
KLLGFHAREGSEHRMLVYERLYHGSLDRLLYGRSDGPSIDWNTRMKIAICAAQGLTFLHEEGPFQAMYNEFSTANIQIDKDFSAKLSGYGCVGHIPEEEISSSSSAVGNLSMETLEKGMLTPKSNVWSFGIFLLELLTGRKNLDSRHPKEERNLVKWSRPFLADNYRLSLIMDPQLKGRFPSKAARTIADIAQRCLQKEPSDRPTMRTVVEHLKIIQDLKYSCRFPLQEPASNSGKHMSRSPSLNGIICPAPRLSFSPSPPSGVPVSVSPPRWSGGGPILLPPPRACASSLSLEELDRQESRKSSSSASRRASVEGF

SEQ ID NO: 1385 - protein, 574 aa, Glycine max
MDEDFDMAAAEPMGEDFDFAGSGSNPVLKVGEEKEIGKEGLKKKLLKEGEGWDTPEAGDEVQVHYTGTLLDGTKFDSSRDRGTPFSFTLGQGQVIKGWDQGIITMKKGENALFTIPAELAYGESGSPPTIPPNATLQFDVELLSWTSVKDICKDGGLFKKILTEGEKWENPKDPDEVLVKYEAHLEDGTLVAKSDGVEFTVNDGHFCPAFSKAVKTMKKGEKVLLTVKPQYGFGEKGKPAHGDEGAVPPNATLQITLELVSWKTVSEVTDDKKVIKKILKEGEGYEHPNEGAIVKLKVIGKLQDGTLFLKKGHDDEGGLFEFKTDEEQVIDGLDRAVLTMKKGEVALLTIAPEYAFGSSESQQELAVVPPNSTLYYEIELVSFEKEKESWDMDTPEKIEAAGKKKEEGNALFKAGKYARASKRYEKAVKFIEYDTAFSEEEKKSSKSLKVACNLNNAACKLKLKDYKQAEKLCTKVLDLESTNVKALYRRTQAYIQLADLDLAEFDIKKALELEPNNRDVKLEYVTLKEKMKEYNKKEAKFYGNMFNKLHKLDSLDNSKPASKDAQPINIDSKS

SEQ ID NO: 1386 - protein, 294 aa, Glycine max
MAENASIELNKFVFFCLLVLIQVAVSEIIFEERFDDGWRGRWVKSDWKSSEGKAGSFKHTAGKWASDPDDKGIQTSSDAKHFAISAKIPEFTNKNRTLVLQYSVKFEQEIECGGGYIKLLSGFVNQKKFGGDTPYILMFGPDLCGTDTKKLHVILSYHGQNYPIKKDLQCETDRLTHFYTFILRPDATYSVLVDNRERDSGSMYTDWDILPPRKIKDVKAKKPKDWEEREYIEDPNDVKPEGYDSIPREIPDPNAKEPENWDEEEDGKWKPPKIPNPAYKGPWKRKVCLSSLRS

SEQ ID NO: 1387 - protein, 321 aa, Glycine max
SLAGPNIMLRNLLWATSKHDVYFMQNYSVMHWSALLRRGKEVLNVAKPIIPTLKRPGFLAQPVSRVQISTMTVKENLMVAGGFQGELICKNLKHPGVLFCGKITTDDNAITNAVDVYSNPAGSLRVITANNDFQVRVFDAENFASLGCFKYDWSVNNTSVSPDGKLLAVLGDSTECLIADANTGKITGSLKGHLDYSFSSAWHPDGQILATGNQDKTCRLWDIRNLSQSMAVLKGRMGAIRALRFTSDGRFLAMAEPADFVHIFDSHSGYEQGQEIDLFGEIAGISFSPDTEALFVGIADRTYGSLLEFNRKRHYNYLDSF

SEQ ID NO: 1388 - protein, 201 aa, Glycine max
MSFQDIEAGRPFGSRRGLMNGKQDPTQAVAAGIFQINTAVSTFQRLVNTLGTPKDTLDLREKLHKTRLHIGQLVKDTSAKLKQASDIDHHAEVNASKKIADAKLAKDFQAVLKEFQKAQRLAAERETAYTPFVPQAVLPSSYTASEVDVGSDKSPEQRALLVESRRQEVLFLDNEIAFNEAIIEEREQGIQEIQQQNLRIW

SEQ ID NO: 1389 - protein, 273 aa, Glycine max
MSFQDIEAGRPFSSRRGLMNGKQDPTQAVAAGIFQINTAVSTFQRLVNTLGTPKDTPDLREKLHKTRLHIGQLVKDTSAKLKQASDIDHHAEVNASKKIADAKLAKDFQAVLKEFQKAQRLAAERETAYTPFVPQAVLPSSYTASEVDVGSDKSPEQRALLVESRRQEVLFLDNEIAFNEAIIEEREQGIQEIQQQIGEVNEIFKDLAVLVHEQGAMIDDIGSNIENSHAATAQAKSQLAKASKTQRSNSSLTCLLLVIFGIVLLIVIIVLAA

SEQ ID NO: 1390 - protein, 273 aa, Picea sitchensis
MSFQDLESGRPLSIRREAINGKQDPSQAVASGVFQINTAVSTFQRLVNTLGTPKDTPELRERLHKTRQHIGQLVKDTSAKLKAASETDQHTEVSANKKIADAKLAKDFQAVLKEFQKAQRLAAERETAYTPFIPQAVLPSSYIASELGLSPDKTQEQQALLIESRRQEVLQLENEVVFNEAIIEEREQGLQEIQQQIGEVNEIFKDLAVLVHEQGVMIDDIDSNIESSYSATVQAKSQLAKASKSQKSNSSLTCLLLVIFGVVLLIIIIVLAA

SEQ ID NO: 1391 - protein, 231 aa, Euphorbia antiquorum
  misc_feature (119)..(119): Xaa can be any naturally occurring amino acid
  misc_feature (158)..(158): Xaa can be any naturally occurring amino acid
MKRLRHPNVLLFMGAVTSPQRLCIVTEFLPRGSLFRLLQRNTTKLDWRRRVHMAMDIVRGMNYLHHFNPPIIHRDLKSSNLLVDKNWTVKVGDFGLSRLKHATFLTTKTGRGTPQWMAXEVLRNEPSDEKSDIYSFGVIMWELATEKIPWDNLNSMQXIGAVGFMNQRLEIPKDIDPQWSSIIESCWHSDPQSRPTFQELLEKFRDLQRQYTIQFQAARSAAGDAAQKEVL

SEQ ID NO: 1392 - protein, 232 aa, Euphorbia antiquorum
MSFQDLEAGKPFASSRRDLINGKKDSTQAVVSGIFQITTYVSTFQRLVNTLGTPKDTPELREKLHKTRLHIGQLVKDTSAKLKQASETDHHAGVSQSKKIADAKLAKDFQAVLKEFQKAQRLAAERETAYTPFVPQAVVPSSFKAAEMDSGLEQIQEQRPLVQATRQEVLLLDNEIVFNEAVIEEREQGIHEIQQQIGEVNEIFKDLAVLVHEQGVMIDDIGSHLENSQAAT

SEQ ID NO: 1393 - protein, 362 aa, Euphorbia antiquorum
  misc_feature (134)..(134): Xaa can be any naturally occurring amino acid
GVKLYEGAGKIVGPNEVEVTQLDGTKLSYSAKHILIATGSRAQRPPIPGQELAITSDEALSLEDVPKRVVILGGGYIAVEFASIWRGMGATVDLVFRKELPLRGFDDEMRAVVARNLEGRGINLHPRTSLSQLXKTEEGIKVTTDHGVDILADVVLFATGRAPNTKILNLGSAGVELDSAGAIKVDEFSRTNVPSIWAIGDVTNRMNLTPIALMEGTCFAKTVFGGQPSKPDYKDVPYAVFSIPPLSVVGLSEEQAIEQGKSDILVFTSSFNPMKNTISGRQEKTVMKLLVDAETDKVLGASMCGPDAPEVIQGIAVALKCGATKAQFDSTVGIHPSAAEEFVTMRTATRTVSGSNKPKTNL

SEQ ID NO: 1394 - protein, 267 aa, Fragaria  ananassa
KNKTLVIQYSIKFEQDIECGGGYIKLLSGYVNQKKFGGDTPYSFMFGPDLCGSQTKKLHLILSYQGQNYPIKKDLQCETDKLTHFYTFILRPDATYSVLVDNRERDSGSMYTDWDILPPRKIKDVNARKPSDWDDRDYIEDVKAAKPEGYDSVPSEIPDPKAKEPEDWDEEENGLWRPPKIPNPAYKGPWKRKKIKNPNYKGKWKTPWIDNPEFEDDPDLYVLKPIKYVGIEVWQVKAGSVFDNILICDDPQYAKQVVEEIFSIERL

SEQ ID NO: 1395 - protein, 359 aa, Fragaria  ananassa
PALSKAVKTMKKGEKVLLAVKPQYGFGDKGKAASGDEGAVPPNATLHITLELVSWRTVSELTDDKKVIKKILKEGEGYERPNEGAVVTVKLIGKLQDGTVFLKKGHGEGEEPFEFKTDEEQVIEGLDKAVVTMKKGEIALVIIAPEYAFGVSESKQELAVVPPNSTLYYEIELVSFVKDKESWDMNTPEKIEAAGKKKEEGNAFFKAGKYAKASKRYEKAVKYIEYDTAFAEEEKKQAKALKVACNLNDAASKLKLKEYKQAEKLCTKVLELEGRNVKALYRRAQAYIQLADLDLAELDIKKALEIDPNNRDVKLEYKTLKEKMKEFNKKEAKFYGNMFAKLTKDSDKDAEPMSVDSKA

SEQ ID NO: 1396 - protein, 232 aa, Fragaria  ananassa
MSFQDYRDLEAGRGSAQSRRDPTQAVASGIFQITTAVSTFQRLVNTIGTPKDTPELREKLHKTRLHIGQLVKDTSEKLKLASERDHHTEVNGRQKVADAKLAKDFQAVLRDFQKAQRLSAERETAYAPFVPQAVLPSSYTASEIDTSDKSPEQRALLVESRRQEVLLLDNEIAFNEAIIEEREQGIQEIQQQIGEVNEIFKDLAILVHEQGTMIEDIDSNVESAHAATSQAK

SEQ ID NO: 1397 - protein, 126 aa, Saccharum officinarum
  misc_feature (82)..(82): Xaa can be any naturally occurring amino acid
MGAVTSPQRLCIVTEFLPRGSLFRLLQKSATKLDVRRRVHMALDIARGMNYLHHSSPPIIHRDLKSSNLLVDKNWTVKVADXGLSRLKRETFLTTKTGKGTPAWMAPEVLRSEPSDEKSDVYSYGV

SEQ ID NO: 1398 - protein, 222 aa, Saccharum officinarum
  misc_feature (146)..(146): Xaa can be any naturally occurring amino acid
MGTRRGGGVLHGLLALSSLLLLASGEIIFEERFEDGWETRWVESDWKRSEGKAGRFKHTAGRYSADLDDKGIQTTMDARHFAISAKFPQFSNKNRTLVVQYSIKFEQDIECGGGYIKLMSGYVNQKKFSGDTPYSLMFGPDICGTXTKKLHLILSYQGQNYPIKRDLECETDKLTHFYTFILRPDAVYSLLVDNRERETGSMYTDWDIPPSSVNKGCQAKRP

SEQ ID NO: 1399 - protein, 208 aa, Saccharum officinarum
MAASSLCRRHLLLFLLVAVASDCLGTAAAHQAGSGEGYTIAGRVKIDGASAKGFGLPAKTSNTKVILNGGQRVTFARPDGYFAFHNVPAGTHLIEISSIGYFFSPVRVDISARNPGYIQAALTETRRVLNELVLEPLKEEQYYEVREPFSVMSLLKSPMGLMVGFMVLMVFVMPKLMENIDPEEMKQAQEQMRNNPVSFSGLLSRAQG

SEQ ID NO: 1400 - protein, 84 aa, Saccharum officinarum
PDRMALKLAPCASAAQNPSSAPSSSCCNAVHSIGKQSPKCLCAVMLSKTAKSAGIKPEVAITIPKRCNLVDRPIGYKCGDYTLP

SEQ ID NO: 1401 - protein, 495 aa, Saccharum officinarum
MARKMLVDGEVAAVADAGQYDYDLFVIGAGSGGVRGSRFAASFGAKVAICELPFHPISSEWLGGHGGTCVIRGCVPKKILVYGASFSGEFEDSKNFGWEINGDINFNWKKLLENKTKEIVRLNGVYQRILTNAGVTMIEGAGSLVDAHTVEVSQPDGSKQRYTAKHILIATGSRAQRVNIPGKELAITSDEALSLEELPKRAVILGGGYIAVEFASIWRGMGAEVDLFYRRELPLRGFDDEMRAVVASNLEGRGIKLHPGTNLSELSKTADGIKVVTDKGEELIADVVLFATGRTPNSQRLNLQAAGVEVDQIGAIKVDEYSRTSAPSVWAVGDVTNRINLTPVALMEATCFAKTVFGGQQVKPDYGDVPCAVFSIPPLSVVGLSEQQALEEANGDILVFTSSFNPMKNSISKRQEKTIMKLVVDAETDRVLGASMCGPDAPEIIQGIAIALKCGATKANFDSTVGIHPSAAEEFVTMRTVTRRLSPTSKPKTNL

SEQ ID NO: 1402 - protein, 316 aa, Saccharum officinarum
  misc_feature (162)..(162): Xaa can be any naturally occurring amino acid
SAEMEDACAAAPRFADVPVRLLASRRDLDGLGLDADALRLPAHLFGVFDGHGGAEVANYCRERLQVLLRQDLRLLGKDLGETAEVDMKEHWDELFTRCFQRLEDEVSGQASRLVDGVQESRPVAAENVGSTAVVAVVCSSHAVVANCGDSRAVLCRGKEPVXLSIDHKPDRKDERARIEALGGKVIQWNGYRVSGILAMSRSIGDRYLKPFVIPKPEVTVFPRAKDDDCLILASDGLWDVVTNEEACKVARRQIQMWHKNNSVTSSLCNGSDESTDPAAQAAADYLMRLALKKGTEDNITVIVVDLKPRKKLKSNP

SEQ ID NO: 1403 - protein, 231 aa, Saccharum officinarum
MTTAARPTWAPAKGGNEQGGTRIFGPSQKYSSRDLAAHTSLKPRKDGQQTQEELQKRDFREELEERERKHYSSKDKSYAEERDRRKSSSQLLLEGSKREAEDKIVPREIDADDSDVEPKSDDESDEDDDDDDDTEALMAELERIKKERAEEKLRKERQQAEEEAKMKEAELMRGNPLININNPGSFSVKRRWDDDVVFKNQARGETKTPKRFINDTIRSDFHRKFLQRYMK

SEQ ID NO: 1404 - protein, 208 aa, Saccharum officinarum
MAASSLCHRHLLLFLLVAVASACLGTAAAHQAGSGEGYTIAGRVKIDGASAKGFGLPAKTSNTKVILNGGQRVTFARPDGYFAFHNVPAGTHLIEVSSIGYFFSPVRVDISARNPGYIQAALTETRRVLNELVLEPLKEEQYYEVREPFSVLSLLKSPMGLMVGFMVLMVFVMPKLMENIDPEEMKQAQEQMRNNPVSFSGLLSRAQG

SEQ ID NO: 1405 - protein, 74 aa, Saccharum officinarum
MAEPAKPEVTEEAKMDLLEDDDEFEEFEIDQEWDDKEEGNEALQQWEDDWDDDDVNDDFSLQLRKELESNASKN

SEQ ID NO: 1406 - protein, 578 aa, Saccharum officinarum
MAEAAPAAAGGGIGDILATAERDFLVRNSGEQVKISSIEASPVAIYFSASWCPPCRRFTPKLIEVYKELASQGKSFEVVFASADQNEEAFNEYFAKMPWLAVPFSDTEGRAALDGRFKVSGIPHLVILDAKTGDVCTEDGVEFVSEYGVEAYPFTPDRINELKEQEKAEKENQTIQSVLGTPTRDYLISNKGDKVPISELEGKYVGLCFVVDGYGPVIEFTNLLAKIYEKLKEVGEKFEVVAVSLDSEESAFNESFAKMPWLAIPQGDQKCEKLVRYFELRSLPTLVLIGPDGKTLNSNVADIIDEHGFEAWEGFPFSAEKLEILAEKAKAKAASQTLESLLISGELDFVIGKDGAKVPVSELVGKTVLLYFSAKWCGPCRAFLPTLVKEYNKIKEKNSDFEIVFISSDRDQSSFDDFFSQMPWLAVPLEDERKASLKKTFKIRGIPSLVAIGPTGQTVSRDAKAQLMIHGADAFPFTEERLEELQKKLDEMAKGWPQKLKHELHDEHELVLLRRGTYGCDACEEMGSTWSYRCDECDFDLHPKCALEEEKKGEEEEGKSTEEAPAGYVCEGGVCRKA

SEQ ID NO: 1407 - protein, 129 aa, Saccharum officinarum
  misc_feature (46)..(46): Xaa can be any naturally occurring amino acid
KVPTKVMPPMNKQMDPLNQIRFMKEFQKPSTQLDMTLEMMSDPMMXTLDKDEAEEETEELTNQVLDEIGVDVASQLSSAPKGRIGATNKKVDNSQARNAAAPARNVAAPPESSAEVDDLERRLASLRRI

SEQ ID NO: 1408 - protein, 228 aa, Saccharum officinarum
  misc_feature (189)..(189): Xaa can be any naturally occurring amino acid
MAPAKSGEKATSFAMACSLLSRYVRQSSTAAGDLGLAIRAEADAKRTSADTEKVETAKETMDLFPQNAGFGSEAAMKEAPDAREPEKHQLTIFYGGKVLVFDDFPAEKAKDLMQMASKGSSVAQNPGLLPPPTVATVTDSTKIAAAPAAPIAVVNAQKSAADIPQAPKASLRRFLEKRKDRLTAKAPYXGSPSDATPVKKEMAEGQPWLGLGPQIANPDLSLCKEGSQ

SEQ ID NO: 1409 - protein, 398 aa, Saccharum officinarum
MDEDFEMPPAGADEMMGDDEMGDFGGDEGPVLKVGEEKEVGKQGLKKKLLKEGEGWETPEVGDEVEVHYTGTLLDGTKFDSSRDRGDPFKFKLGQGQVIKGWDQGIKTMKKGENAVFTIPPELAYGASGSPPTIPPNATLQFDVELLSWTSVKDICKDGGIFKKILKEGEKWENPKDPDEVLVKYEARLEDGTVVSKSEGVEFTVKDGYFCPALAKAVKTMKKAEKVLLTVKPQYGFGEKGRPAAGEEGDVPPNATLVIDLELVSWKTVTEIGDDKKILKKVLKEGEGYERPNEGAVVEVKITGKLQDGTVFTKKGHDEEPFKFKTDEEEVIDGLDRAVLNMKKGEVALVTIPPEYAFGSTESKQDLAVVPPNSTVVYEVELVSFVKDKESWDLNNEE

SEQ ID NO: 1410 - protein, 246 aa, Saccharum officinarum
MGSSEADEDQLLKSFLAEVSEAERDNEVLRILGCFKLNPFEHLKLSFDSSPDEVKKQYRKLSLLVHPDKCKHPQAQEAFAALAKAQQLLLDPQERGYILDQVTAAKEELRAKRKKELKKDSASKIKSLVDEGKYEEQFERSDEFQKQLIIKVREILTEKEWRRRKMQMRISEEEGRLKKDEEETKEMWKRKREHEEKWEETRDQRVSSWRDFMKTGKKGRKGEIKPPKLKTEDPNKSYVQRPVKRN

SEQ ID NO: 1411 - protein, 255 aa, Saccharum officinarum
MESLFGFWDAQSQRRRTGGSGGGFESLKRLGHISPAVQSHLKHVYLTLCSALAFSALGAYLHILLNVGGTLTTLGCLAAIAYLISLPASQDQERNRFALLMAAALLQGASVGPLVDLVIDFDPRILVTAFVGTAIAFGCFSGAAIIAKRREYLYLGGLLSSGLSILLWLQFATSIFGHTSTTFMFELYFGLLVFLGYMVFDTQEIIERAHGGDMDYIKHALTLFTDFVAVLVRILVIMMKNAQEKSEDEKKRKKR

SEQ ID NO: 1412 - protein, 460 aa, Saccharum officinarum
  misc_feature (100)..(100): Xaa can be any naturally occurring amino acid
GEEVIVKLDWRESMPHPDERVEYELWTNSNDECGPRCDEQMAFVRGFRGHAQLLERGGYARFTPHYITWYCPEAFRLTQQCRSQCINHGRYCAPDPEGDXGAGYEGKDVVVENLRQLCVHRVANDTGRPWAWWDYVMDYKIRCSMKEKKYTKTCAEDVVTALGLDLKKVLECMGDPEADADNAVLSKEQEDQIGSGSRGDVTILPTLVINNVQYRGKLERTAVLKAVCAGFKEGTEPRVCLSHDIETNECLHRNGGCWRDEATNVTACQDTYRGRVCECPVVNGVRYEGDGYTDCKPIGPGRCALNNGGCWSETRGHQIFSACTETALTGCRCPSGFHGDGHKCEDLDECREKLACTCPGCQCKNTWGNYECKCKGNQLYIRGEDVCIANNMSKLGWFITIAAVACVVGIGVAGYVFYKYRLRSYMDSEIMSIMSQYMPLDSQNNENQPLRQHDSEALRH

SEQ ID NO: 1413 - protein, 214 aa, Saccharum officinarum
  misc_feature (162)..(162): Xaa can be any naturally occurring amino acid
  misc_feature (211)..(212): Xaa can be any naturally occurring amino acid
SAEMEDACAAAPRFADVPVRLLASRRDLDGLGLDADALRLPAHLFGVFDGHGGAEVANYCRERLQVLLRQDLRLLGKDLGETAEVDMKEHWDELFTRCFQRLEDEVSGQASRLVDGVQESRPVAAENVGSTAVVAVVCSSHAVVANCGDSRAVLCRGKEPVXLSIDHKPDRKDERARIEALGGKVIQWNGYRVSGILAMSRSIGMYIGSSXXSW

SEQ ID NO: 1414 - protein, 225 aa, Saccharum officinarum
  misc_feature (82)..(82): Xaa can be any naturally occurring amino acid
LRESKKDYDVPTAISLMKQMSSAKFVESAEAHFRMNLDPKYNDQQLRATVNLPKGTGQSVKIAVLTQGEKIDEARAAGADIXGGEDLIEQIKGGFMEFDKLIASPDMMPKVAGLGKILGPRGLMPNPKAGTVSPNITQAIEEFKKGKVEYRVDKSGIVHIPFGKVDFPEEDLIANFMAVVRSVERNKPSGAKGIYWKTAYLCSSMGPSIKLNIKEMLDYGLDSSD

SEQ ID NO: 1415 - protein, 77 aa, Saccharum officinarum
  misc_feature (40)..(40): Xaa can be any naturally occurring amino acid
MAAAPAPADAKAEAAKMDLLEDDDEFEEFEIDQEWDDKEXGNEAVQQWEDDWDDDDVNDDFSLQLRKELEGSNAQKS

SEQ ID NO: 1416 - protein, 231 aa, Saccharum officinarum
MNIFKKKVDPKEALRTSKREMAVATRGVEREIGSLQMEEKKLVAEIKKTAKTGNEAATKILARQLVRLRQQILNLQGTRAQIRGVATHTQAMYAGTSISAGMKGASKAMAAMNKQMEPVKQIKVMKEFQKQSTQLDMTLEMMSDAIDETLDKDEAEEETEELTNQVLDEIGVDVASQLSSAPKGRIGATNKKVDNSQARNAAAPARNVAAPPESSAEVDDLERRLASLRRI

SEQ ID NO: 1417 - protein, 520 aa, Saccharum officinarum
  misc_feature (467)..(467): Xaa can be any naturally occurring amino acid
  misc_feature (513)..(513): Xaa can be any naturally occurring amino acid
TPKLIEVYKELASQGKSFEVVFASADQSEEAFNEYFAKMPWLAVPFSDTEGRAALDGRFKVSGIPHLVILDAKTGEVYTEEGVEFVSEYGMEAYPFTPDRINELKEQEKAEKENQTIQSVLGTPTRDYLISNKGDKVPISELEGKYVGLCFVVDGYGPVTEFTDLLAKIYEKLKEVGEKFEVVAVSLDSEESTFNENFAKMPWLAIPQGDQKCEKLVRYFELRSLPTLVLIGPDGKTLNSNVADIIDDHGFEAWEGFPFSAEKLEILAEKAKAKAASQTLESLLISGDLDFVIGKDGAKVPVSELVGKTVLLYFSAKWCGPCRAFLPTLVKEYNTIKEKNSDFEIVFISSDRNQSSFDDFFSEMPWLALPLEDERKTSLKKTFKIRGIPSLVAIGPTGHTVSRDAKAQLMIHGADAFPFTEERLEELQKKLDEMAKGWPQKLKHELHDEHELVLLRRGTYGCDACEXMGSTWSYRCDECDFDLHPKCALGEEKKGEEEEGKSTEEAPAGYVCXGGVCRKA

SEQ ID NO: 1418 - protein, 77 aa, Saccharum officinarum
  misc_feature (40)..(40): Xaa can be any naturally occurring amino acid
MAAAPAPADAKAEAAKMDLLEDDDEFEEFEIDQEWDDKEXGNEAVQQWEDDWDDDDVNDDFSLQLRKELEGNNAQKS

SEQ ID NO: 1419 - protein, 477 aa, Helianthus annuus
  misc_feature (103)..(103): Xaa can be any naturally occurring amino acid
  misc_feature (125)..(125): Xaa can be any naturally occurring amino acid
  misc_feature (129)..(129): Xaa can be any naturally occurring amino acid
  misc_feature (138)..(138): Xaa can be any naturally occurring amino acid
MDIEGRKQNSHPIKKESWREVMTLAYQSLGVVYGDLSTSPLYVYKSAFAEDIQHSESNEEIFGVLSFVFWTLTLIPLLKYVFIVLRADDNGEGGTFALYTLLXRHARVSTLPNGQLADEELYEYXRDEXGSGSRDIGXSLKSTLEKHKILQKGLLVLALLGTCMVIGDGVLTPAISVFSAVSGLELSISREYHQYVEVPFACIILVLLFCLQHYGTHRVGFLFAPIVITWLLCISTIGIYNIFHWNPQVFQALSPYYMYKFLKKTRTGGWKSLGGILLCIIGSEAMYADLGHFSQLSIKMAFTFVVYPSLILAYMGQAAYLSKHHILETDYRIGFYVSVPEKIRWPVLGIAILAAVVGSQAIITGTFSIIKQCSALGCFPRVKVIHTSPTNKHGQIYIPEINWTLMLLCLAVTVGFRDLKHISNVAGLAVITVMLVTTCLMSLVMVLCWRKSVFLALGFMFFFWLIEIIYFSASLIK

SEQ ID NO: 1420 - protein, 491 aa, Helianthus annuus
  misc_feature (110)..(110): Xaa can be any naturally occurring amino acid
MSRKMLIDGDVSNVSDEDQYDFDLFVIGAGSGGVRASRFSAQYGAKVGICELPFHPVSSETVGGVGGTCVIRGCVPKKILVYGAGFGPEIQDAREYGWQVNENVDFDWKXLLHKKTEEIVRLNGVYKRLLSNAGVKLFEGEGRIVGPNEVEVIQLDGTKLSYSAKHILISTGSRAHRPDIPGHELAITSDEALSLEELPKRVVILGGGYIAVEFASIWRGMGSTVNLCFRKELPLRGFDDEMRALVARNLEGRGIILHPQTNLTKLVKTEDGIKVTTDHGEELMADVVLFATGRVPNTKRLNLQAVGVEVDKIGAVKVDEYSRTSVPSIWAIGDVTNRMNLTPVALMEGSMFAKTVFGNEPSKPDHSNVPCAVFCIPPLSVVGLSEEQAIEHATGDILVFTSTFKPMKNTISGRQEKTLMKLIVDADTDKVIGASMCGPDAPEIMQGIAIAIKCGATKAQFDNTVGIHPSAAEEFVTMRSATRRIAVAGKP

SEQ ID NO: 1421 - protein, 568 aa, Helianthus annuus
  misc_feature (148)..(148): Xaa can be any naturally occurring amino acid
MDEDFDIPAADEMNDDFMDDIEAPVTLKVGEEKEIGNQGLKKKLLKEGEGWDTPESGDEVEVHYTGTLVDGTKFDSSRDRGEPFKFTLGQGQVIKGWDLGIKTMKKGENALFTIPADLAYGEAGSPPTIPPKATLQFDVELLSWVSVXDICKDGGIFKKIVKEGEKWENPKDLDEVLVNYEVRLEDGTLVAKSDGVEFAVQDGHFCPALSKAVKTMKKGEKVILTVKPEYGFGEKGKPASGDEAAIPANATLQITLELLSWKVVSNVTDDKKVVKKILKEGEGYERPNEGAVVQVKLIGKLQDGTVFIKKGHDDSEPFEFKADEEQVIDGLDRAVLTMKKGEVALLTVAPEYAFGSTGSEQELAVVPPNATVTYEIELVSFVKDKESWDMTTTQEKIEAAGKKKEEGNAFFKAGKYKKAVKRYEKAAKYIEYDTNFEEEEKKQAKALKITCNLNNAACQLKLKEYKQAEKLCTKVLELESTNVKALYRRAQAYINVADLDLAELDIKKALEIDPNNKDVKLEYKVLKEKIKEYNKKDAKFYGNMFAKMTKSSSNKAKEAEPMSIDSKA

SEQ ID NO: 1422 - protein, 249 aa, Helianthus annuus
MGEANTSSIDDDLLLKSFYAEVSEVERDNEVVRILSCFKLNAFEYLNLPFDSSPEDVKKQYRKLSLLVHPDKCKHPQAKEAFSALAKAQQLLLDPQEREYLVNQINAAREELRAKRKKQLKKDTASKLKSLVDEGKYEQEYEKSDEFQAQLKLKVREILTDQEWRRRKMQMRISEEEGRLKKDEEESKEMWKRKREHEEQWEGTRENRVSSWRDFMKGGKKVKKGELRPPKLKTEDPNKSYVQRPVKRG

SEQ ID NO: 1423 - protein, 275 aa, Helianthus annuus
MSFQDLEAGRPLNTRRVGYTNGFKQQDPTQAIASGIFQINTAVNSFQRLVKTLGTPKDTHELREKLHKSRLHIGQLVKDTSEKLKQASETDHRAEVSVSKKITDAKLAKDFQAALKEFQKAQRLAAERETAYTPSVPQAVLPSSYAASEMDIGSDRSQEQRVLLMESRREVLLLDNEIAFNEAIIEERDQGIQEIQNQIGEVNEIFKDLAVLVHEQGAMIDDIGSNVENSHAATAQARSHLAQASKTQRANSSMTCLLLVIVAIVLCIVVIIVAV

SEQ ID NO: 1424 - protein, 431 aa, Helianthus annuus
  misc_feature (252)..(252): Xaa can be any naturally occurring amino acid
RWIFSGASTPRGDIPPSQFTTKPSTDSGDESETKVGIHKILSSKAEAWMGKKGITWPWRGNERERDSKTGRFGLHWLHNDQEHDSGQQTSSSKVESQPWENMNRNEATGSWSSFNVNSTSSASSCSSTNSSAINKVDMDTDSLDYEILWEDLTIGEQIGQGSCGTVYHAMWYGSDVAVKVFSRQEYSEDVILSFRQEVSLMKRLRHPNILLFMGAVTSPQRLCIVTEFLPRGSLFRLLQRNTAKLDWRRRVXMAMDIARGMNYLHHCHPPIIHRDLKSSNLLVDKNWNVKVGDFGLSRIKHETYLTTKTGKGTPQWMAPEVLRNEQADEKSDVYSFGVVLWELTTEKIPWDTLNSMQVIGAVGFMNQQLDIPKDVDPQWASLIESCCCSEPQSRPTFQEILDKLKELQKKFTLQLQASRTATTAASTATTT

SEQ ID NO: 1425 - protein, 219 aa, Helianthus annuus
  misc_feature (95)..(95): Xaa can be any naturally occurring amino acid
MSFQDIEAGRPINSRRGVIRKQDPTQAVASGIFQINTAVSTFQRLVNNLGTPKDTPELRDKLHKTRLHIGQLVKDTSDKLKQASETDHHAGVSAXKKITDAKLAKDFQTVLQEFQKAQRLSAERETAYAPFVPQSSLPSRDPASEADVSSDRSQEQQALLVESKRQEVLLLDNEIAFNEAIIEERDQGIQEIQNQIGEVNEIFKDLAVLVHEQGTMIDD

SEQ ID NO: 1426 - protein, 190 aa, Helianthus annuus
MSFQDLEAGRPLNTRRVGYTNGFKQQDPTQAIASGIFQINTAVNSFQRLVKTLGTPKDTHELREKLHKSRLHIGQLVKDTSEKLKQASETDHRAEVSVSKKITDAKLAKDFQAALKEFQKAQRLAAERETAYTPSVPQAVLPSSYAASEMDIGSDRSQEQRVLLMESRRQEVLLLDNEIAFNEAIIEERD

SEQ ID NO: 1427 - protein, 335 aa, Helianthus annuus
RGALSSCLPEDDEQASTSSSAVHSPQLKFAALLLVLLSICTPSFSEIIFEERFDDGWQSRWVKSDWKKSEGKAGSFKHTAGSWSADPDDKGIQTSTDARHYAISAKIPEFSNKNRTLVLQYSIKFEQDIECGGGYIKLMSGYVNQKKFGGDTPYSVMFGPDLCGTQTKKLHVILSYQGQNYPIKKDLQCETDKLTHFYTFILRPDASYSVLIDGRERDSGSMYTDWDILPPRKIKDVNAKKPADWEEREYIDDPNQVKPEGYDSIPREIPDPKAKQPDTWDEDEDGVWRPPKIPNPAYKGPWKPKKIKNPNYKGKWKIPWIDNPEFEDDPDLYVL

SEQ ID NO: 1428 - protein, 568 aa, Helianthus annuus
  misc_feature (243)..(243): Xaa can be any naturally occurring amino acid
  misc_feature (245)..(245): Xaa can be any naturally occurring amino acid
MEDDFDFSAAGAMNDEMMDETPSYDAPLKVGEEKEIGNQGLKKKLLKEGEGWDTPDNGDEVEVHYTGTLLDGTQFDSSRDRGTPFKFTLGQGQVIKGWDQGIKTMKKGENALFTIPAELAYGESGSPPTIPPNATLRFDVQLLSWLSVKDICKDGGIFKKILNKGEKWENPKDLDEVLVNYEVRLEDGTLVAKSDGVEFTVQDGHFCPALSKAVKTMKKGEKVLLTVKPQYGFGEKGKQALGXEXAIPANATLQITLELVSWKTVSDVTKDRKVMKKILKEGEGYERPNEGAVVQVKLIGKLQDGTVFINRGYDDGTELFDFKTDEEQVIDGLDRAVMTMKKGEVAILTIAPEYAFGSTESKQELAVVPPNSTVIYEIELNSFIKEKESWDMNTQEKIEAAGKKKEEGNSLFKAGKYLKASKRYEKAVKYIEYDTSFDDEEKKQAKALKVSCNLNDAACKLKLKEYKQAEKLCTKVLESDSGNVKALYRRAQAYIHLADLDLAELDIKKALEIDPDNRDVKLEYKVLKEKMKEYNKKDAKFYGNMFAKLGVLDSKKTAAAPMAIDSKA

SEQ ID NO: 1429 - protein, 624 aa, Helianthus annuus
MKVGKSGFVIWVCFWLLCGSCLGRFVVEKNSLRVTSPDHLKDVYECAIGNFGVPQYGGTLTGVVKYPKSNQKACQSFDSSLKSEPAGGLPLFVLLDRGDCYFTLKAWNAQKAGAAAILVADDRPEPLITMDMPEAESAPADYLQNISIPSALISKSLGDSIKKALNKGEMVNIKLDWTEALPHPDERVEYEFWTNSNDECGTKCDSQINFVKDFKGAAQILEKKGYTQFTPHYITWYCPEAFTLSKQCKSQCINHGRYCAPDPEQDFSKGYDGKDVVVQNLRQACFYKVANETGKPWLWWDYVTDFSIRCPMKDKKYTKECADEVIKSLGIDLKKIDECVGDTEADTDNAVLKAEQETQIGKGSRGDVTILPTLVINNRQYRGKLAKQAVLKAICSGFEETTEPAVCLTDEIQTNECLDNNGGCWTDKAANVTACRDTFRGRVCECPVVQGVKFVGDGYKHCEASGALRCEVNNGGCWKGSKLGRTYSACIDDHTKGCKCPPGFKGDGVNSCEDVDECKEKTACQCSECKCKNTWGSYECSCRGNLLYMREHDTCISKDGKSEVSWGFVWVIILGLAATGAAGYSFYKYRVRTYMDSEIRAIMAQYMPLDNQAEIEVHGTRGNV

SEQ ID NO: 1430 - protein, 623 aa, Helianthus annuus
MKVGFIVLVWFIMFMCGPCLGRFVVEKNSLRVSSPDNLKGTYECAIGNFGVPQYGGTLSGYVGYPKSNQKACETFDSSLKSEPAGGLPLFLLLDRGDCFFTLKAWNAQKGGAAAVLVVDNRPEPLITMDMPEEENVHADYVQNITIPSALISMSLGNSIKKALNKGDMVNIKLDWTEALPHPDERVEYEFWTNSNDECGTKCDSQINFVKNFKGAAQILEKKGYTQFTPHYITWYCPEVFTFSKQCKSQCINHGRYCAPDPEQDFSKGYDGKDVVVQNLRQACFYKVANETGKPWLWWDYVTDFSIRCPMKDKKYTKECADEVIKSLGVDLKKIDECVGDTEADVDNPVLKAEQEAQIGKGSRGDVTILPTLVINNRQYRGKLAKQAVLKAICSGFEETTEPAICLSDEIETNECLDNNGGCWMDKAANITACRDTFRGRVCECPIVQGVKFVGDGYKHCEASGALRCEVNNGGCWKGTQQGRTYSACIDDHTKGCKCPPGFKGDGVNSCEDVDECKEKTACQCPECKCKNTWGSYDCSCSGSLLYMREHDTCISKDGKSEVSWGFVWVMILGLAVAGAAGYAFYKYRVRTYMDSEIRAIMAQYMPLDNQAEIEVHGPTRGNV

SEQ ID NO: 1431 - protein, 497 aa, Helianthus annuus
MSRKMLNDGGVGSGGESEENQYDFDLFVIGAGSGGVRASRFSAQYGAKVGICELPFHPISSETIGGVGGTCVIRGCVPKKILVYGATFGPEIQDSREYGWKVNETVDFDWKKLLHKKTDEIVRLNGIYKRLLSNAGVKLFEGEGRIVGPNEVEVIQLDGTKLSYSAKHILIATGSRAQRLDIPGQELAITSDEALSLEELPKRVVVLGGGYIAVEFASIWRGMGSTVNLCFRKELPLRGFDDEMRALVARNLEGRGIILHPQTNLTQLVKTADGIKVTTDHGEELMADVVLFATGRIPNTKRLNLQAVGVEVDSIGAVKVDEYSRTNVPSIWAIGDVTNRMNLTPVALMEGTMFAKTVFGNEPSKPDHSNIPCAVFCIPPLSVVGLSEEQAIEQAKGDILVYTSTFNPMKNSISGRQEKTLMKLIVSAETDKVIGASMCGPDAAEIMQGIAVALKCGATKAQFDSTVGIHPSSAEEFVTMRSVTRRIAAAGKPKTNL

SEQ ID NO: 1432 - protein, 276 aa, Helianthus annuus
  misc_feature (169)..(169): Xaa can be any naturally occurring amino acid
MSFQDLEAGRPLNTRRVGYTNGFKQQDPTQAIASGIFQINTAVNSFQRLVKTLGTPKDTHELREKLHKSRLHIGQLVKDTSEKLKQASETDHHAEVSVSKKITDAKLAKDFQAALKEFQKAQRLAAEKETAYTPSVPQAVLPSSYAASEMDIGSDRSQEQRVLLMESRXQEVLLLDNEIAFNEAIIEERDQGIQEIQNQIGEVNEIFKDLAVLVHEQGAMIDDIGSNVENSHAATAQARSHLAQASKTQRANSSMTCLLLVIVAIVLCIVVIIVAV

SEQ ID NO: 1433 - protein, 327 aa, Panicum virgatum
VLLTVKPQYGFGEKGRPAAGEEGAVPPNATLLIDLELVSWKTVTEIGDDKKILKKVLKEGEGYERPNEGAVVKVKITGKLQDGTVFTKKGHDEEPFEFKTDEEEVIAGLDLAVLNMKKGEVALVTIPPEYAFGSVESKQDLAVVPPNSTVIYEVELVSFVKDKESWDLNNEEKIEAAGKKKEEGNALFKLGKYARASKRYEKAAKFIEYDSSFSEDEKKQSKQLKISCNLNNAACKLKLKDYKQAEKLCTKVLELDSQNVKALYRRVQAYMQLADLELAEADIKKALEIDPDNRDVKLEYRALKEKIKEYNKKDAKFYSNMFAKMTK

SEQ ID NO: 1434 - protein, 177 aa, Panicum virgatum
SRSGDGYTIAGRIKIDGANVKGFGLPAKTSNTKVILNGGQRVTFARPDGYFAFHNVPAGTHLIEVSSIGYFFSPVRVDISARNPGYIQAALTETRRVLNELVLEPLKEEQYYEVREPFSVMSLLKSPMGLMVGFMVLMVFVMPKMMENIDPEEMKQAQEQMRNNPVSFSSLLARAQG

SEQ ID NO: 1435 - protein, 195 aa, Panicum virgatum
VFGNTLKTVFEAIVFLFLMHPFDVGDRCEIEDVQMVVEEMNIMTTVFLRYDNLKIYYPNSVLATKPIMNFYRSPDMGEGIDFSIHVATPVEKLALMKERILRYIDNKKEQWYPGAMVVLRDVDDTNKLKVSIWLRHTLNFQDMGMRWTRRELVLQEMIRVLKDLEIEYRVLPLDVNVRTAPPIQSTRMPTTWSYS

SEQ ID NO: 1436 - protein, 77 aa, Panicum virgatum
  misc_feature (65)..(65): Xaa can be any naturally occurring amino acid
MATAPAPAPADPKAEAAKMDLLEDDDEFEEFEIDQEWDDKEEGNEAVQQWEDDWDDDDVNDDFSXQLRKELEGTQKS

SEQ ID NO: 1437 - protein, 184 aa, Panicum virgatum
METCPSVKNILLLDSEGKRVAVKYYSDDWPTLSAKLAFEKSVFAKTQKANAGTEAEIVMFDGQIVVYKFIQDLHFFVTGGEEENELILASVLQGFSDAADRLLKNMVDKRTALENLDLILLCLDEIVDGGIVLETEGREIAEKVTGHGLESASSAEQTLLNALTQAREHLAKSLYVMLLLSIWG

SEQ ID NO: 1438 - protein, 81 aa, Panicum virgatum
RTVSRVPMAEPAKPEVTEEAKMDLLEDDDEFEEFEIDQEWDDKEEGNEALQQWEDDWDDDDVNDDFSLQLRKELESNAPKK

SEQ ID NO: 1439 - protein, 316 aa, Panicum virgatum
SAEMEDACAAAPRFAHVPVRLLASLRDLDGLGLDADELRLPAHLFGVFDGHGGAEVANYCRERLQVLLSQELSRLGKDLGEVGVVDMKEHWDELFSKCFQRVDDEVSGRVSRLVGGVQESRQVAPENVGSTAVVVVVCSSHLVVANCGDSRVVLCRGKEPVALSIDHKPDRKDERARVEALGGKVIQWNGYRVSGILAMSRSIGDRYLKPFVISKPEVTVIPRAKDDDCLILASDGLWDVVSNEEACKVARRQIQLWHKNNGVTTSLCDEGDESTDPAAQSAADYLMRLALKKGTEDNVTVIVVDLKPRKKLKNNS

SEQ ID NO: 1440 - protein, 115 aa, Panicum virgatum
MRPLVVLGLVLVLAAGVALDGVDGAGECGRASADRVALRLAPCVSAADDPQSTPTSSCCSAVHTIGQSPSCLCAVMLSGTARAAGIKPEVAITIPKRCNMADRPVGYKCGDYTLP

SEQ ID NO: 1441 - protein, 258 aa, Panicum virgatum
  misc_feature (93)..(93): Xaa can be any naturally occurring amino acid
GSAFTPPTRPRTGKAALPLKRDRTRSKRFLEIQKLRESKKEYDVPTAISLMKQMASAKFKESAEAHFRMNLDPKYNDQQLRATVNLPKGTGQXVKIAVLTQGEKIDEARAAGADIVGGDELIEQIKGGFMEFDKLIASPDMMPKVAGLGKILGPRGLMPNPKAGTVSPNITQAIEEFKKGKVEYRVDKTGIVHIPFGKVDFPEEDLIANFMAVVRSVERNKPSGAKGIYWKTAYLCSSMGPSIKLNIKEMLDYGTESS

SEQ ID NO: 1442 - protein, 177 aa, Panicum virgatum
  misc_feature (108)..(108): Xaa can be any naturally occurring amino acid
  misc_feature (116)..(116): Xaa can be any naturally occurring amino acid
MESLFGASRRTTAGGGFDSLKRLGHISPAVQSHLKHVYLTLCSALAFSALGAYLHIALNIGGTLTTIGCLAAIAFLISLPASQHQERNRFALLMSAALLQGASVGPLXDLVLHLDXRILVTAFVGTAIAFGCFSAAAIIAKRREYLYLGGLLSSALSILLWLQFAASIFGHYYFTFE

SEQ ID NO: 1443 - protein, 117 aa, Panicum virgatum
MTMRPLVVLGLVLVVAAGVALDGADGAGECGRASADRVALRLAPCISAADDPQSTPTSSCCSAVHAIGQSPSCLCAVMLSGTARAAGIKPEVAITIPKRCNMADRPVGYKCGDYTLP

SEQ ID NO: 1444 - protein, 232 aa, Panicum virgatum
MTTAARPTWAPAKGGNEQGGTRIFGPSQKYSSRDLAAHTSLKPRKEGQQTQEELQKRNLREELEDRERKHYSSKDKSYAEERDRRKSSSQLLLEGSKRDAEDKIVPREIDADDSDVEPKSDDESDEDEDDDDDDTEALMAELERIKKERAEEKLRKERQQAEEEAKMKEAELMRGNPLINVNNPGSFSVKRRWDDDVVFKNQARGETKTPKRFINDTIRSDFHRKFLQRYMK

SEQ ID NO: 1445 - protein, 263 aa, Panicum virgatum
  misc_feature (91)..(91): Xaa can be any naturally occurring amino acid
LPLRGFDDEMREVVARNLEGRGIKLHPGTNLSELSKTADGIKVVTDKGEELIADVVLFATGRTPNSDRLNLQAAGVEVDQIGAIKVDEYSXTSAPSVWAVGDVTNRINLTPVALMEATCFSKTVFGGQQVKPDYRDVPCAVFSIPPLSVVGLSEQQALEEAKGDILVFTSSFNPMKNSISKRQEKTVMKLVVDAETDRVLGASMCGPDAPEIIQGIAVALKCGATKASFDSTVGIHPSAAEEFVTMRTLTRRVSPTSKPKTNL

SEQ ID NO: 1446 - protein, 415 aa, Panicum virgatum
  misc_feature (44)..(44): Xaa can be any naturally occurring amino acid
  misc_feature (64)..(64): Xaa can be any naturally occurring amino acid
  misc_feature (117)..(117): Xaa can be any naturally occurring amino acid
  misc_feature (398)..(398): Xaa can be any naturally occurring amino acid
MGRAFLHRALVLSSLLLLASGEIFFEERFDDGWEHRWVKSDWKXSQGQAGTFRHTAGTYSGDPXDKGIQTTGDAKHFAISAKFSEFSNKNRTLVVQYSLKIEQDIECGGAYIKLMSXHVNQKKFGGDTPYSFMFGPDICGDQKKKLHLILSYQGQNYPIKKDLKCETDKLTHFYTFILRPDATYSILIDNREREFGSMYTDWDILPPRRIKDVDAKKPKDWDDREYIEDPDQVKPEGYDSIPKDIPDPKDKKPESWDDDDDGIWKPRMIPNPEYKGPWKRKKIKNPNYKGKWKTPWIDNPEFEDDPDLYVLKPLQYVGIEVWQVKAGSVFDNILICDDPDYARHVVDETFAANKEAEKEAFEGAEKKRKAREEEEARRAREEGERRRRERDRDRGRDXYRDRYKRHRHYDYHDEL

SEQ ID NO: 1447 - protein, 247 aa, Panicum virgatum
  misc_feature (108)..(108): Xaa can be any naturally occurring amino acid
  misc_feature (116)..(116): Xaa can be any naturally occurring amino acid
MESLFGASRRTTAGGGFDSLKRLGHISPAVQSHLKHVYLTLCSALAFSALGAYLHIALNIGGTLTTIGCLAAIAFLISLPASQHQERNRFALLMSAALLQGASVGPLXDLVLHLDXRILVTAFVGTAIAFGCFSAAAIIAKRREYLYLGGLLSSALSILLWLQFAASIFGHYYFTFELYFGLLVFLGYMVYDTQEIIERAHHGDMDYIKHALTLFTDFVAVLVRVLVIMLKNAQEKSQEDKKRKKRY

SEQ ID NO: 1448 - protein, 246 aa, Panicum virgatum
MGSSEADEDQLLKSFLAEVSEAERENEVLRILGCFKLNPFEHLKLSFDSSPDEVKKQYRKLSLLVHPDKCKHPQAQEAFAALAKAQQLLLDPQERGYILDQVTAAKEELRAKRKKELKKDSASKIKSLVDEGKYEEQFERSDEFQQQLIIKVREILTEKEWRRRKMQMRISEEEGRLKKDEEETKEMWKRKREHEEKWEETRDQRVSSWRDFMKTGKKGRKGEIKPPKLKTEDPNKSYVQRPVKRT

SEQ ID NO: 1449 - protein, 106 aa, Panicum virgatum
AAELLLPQGGKKRIQRPGFVSYRTVSRVPMAEPAEPAKPEVTEEAKMDLLEDDDEFEEFEIDQEWDDKEEGNEALQQWEDDWDDDDVNDDFSLQLRKELESNAPKN

SEQ ID NO: 1450 - protein, 346 aa, Panicum virgatum
LVLSSLLLLASGEVFFEERFEDGWESRWVESDWKRSEGKAGRFKHTAGRYSGDPDDKGIQTTMDARHFAISAKFPQFSNKNRTLVVQYSIKFEQDIECGGGYIKLMSGYVNQKKFSGDTPYSLMFGPDICGTDTKKLHLILSYQGQNYPIKKDLECETDKLTHMYTFILRPDASYSLLVDNRERESGSMYTDWDILPPRKIKDVHAKRPKDWDDREYIDDPDDVKPEGYDSIPKQIPDPKDKKPDTWDDDDDGIWKPRMISNPAYKGPWKRKRIKNPNYKGKWKTPWIDNPEFEDDPDLYVLKPLKYVGIEVWQVKAGSVFDNILICDDPEYARKVVEETVGANRE

SEQ ID NO: 1451 - protein, 85 aa, Panicum virgatum
SPHAKQGAALMATAPAPADPKAEAAKMDLLEDDDEFEEFEIDQEWDDKEEGNEAVQQWEDDWDDDDVNDDFSQQLRKELEGAQKS

SEQ ID NO: 1452 - protein, 121 aa, Thellungiella halophila
MASHQEQGFKAGETRGQTQEKTRQAMGAMGEKTDVAKDKTQGAAQSAQQKTHETAQAAKDKASQAAQTTQQKAQESKDKTGSYMSETGETIKNKAQDAAEYTKETAEAGKNKTGGILGQTG

SEQ ID NO: 1453 - protein, 166 aa, Thellungiella halophila
  misc_feature (102)..(102): Xaa can be any naturally occurring amino acid
MGVREKDPLAQLSLPPGFRFYPTDEELLVQYLCRKVAGYHFSLQVIGDIDLYKFDPWDLPSKALFGEKEWYFFSPRDRKYPNGSRPNRVAGSGYWKATGTDXIITADGHRVGIKKALVFYAGKAPKGTKTNWIMHEYRLIEHSRSHGSSKLDDWVLCRIYRKRQEL

SEQ ID NO: 1454 - protein, 309 aa, Thellungiella halophila
  misc_feature (251)..(251): Xaa can be any naturally occurring amino acid
  misc_feature (256)..(256): Xaa can be any naturally occurring amino acid
PSIIMSSVHHISDDPKSPLLPVVHNDDEPCERQSVGQHLRTIFTPKNCYIALGPLLCAVVCLCARLGGDETTTARNMLGVLVWMFAWWLTEAVPMPITSMSPLFLFPIFGISAADDVASSYMDDVIALVLGSFILALAVEHYNIHRRLALNITSVFCVEPLNAPLLLLGICATTAFVSMWMHNVAAAVMMMPVATGILQRLPSSSSSSSEVVPPAVGKFCRAVVLGVIYSASVGGMSTLTGTGVNLILVGXWKSYXPEADPISFSQWFFFGLPLALCIFFVLWGILCVLYCPKGSGKALSPYLPQAHLR

SEQ ID NO: 1455 - protein, 161 aa, Thellungiella halophila
METEKSSKELGLKHLGFVRIAAIHVLVSFTSLYDYAKQNSGPLKSAVGKVEGAVTAVVTPVYNKFKDVPDTLLVFLDHKVGEVSVKFDKHAPPMAKQVVTQASVLMSKATEKAQGFVKEARTGGPKAAFNYAATEYKCFLVTNSVKAWAKLNQYKPIHAVG

SEQ ID NO: 1456 - protein, 151 aa, Thellungiella halophila
MASLMDKAKGFVADKLAGVAKPEGSVTDVDLKDVNRDSVEYLAKVSVTNPYDHAIPICEINFTFHSAGREIGKGKMPDPGSLKAKDMTVLDIPVVVPYNILFNLARDVGVDWDIDYLLEIGLTVDLPIIGNITIPITSKGEIKLPTFKDFF

SEQ ID NO: 1457 - protein, 209 aa, Nicotiana tabacum
  misc_feature (8)..(8): Xaa can be any naturally occurring amino acid
GMPGITAXGGFYELCSPKKGETVYVSAASGAVGQLVGQFAKLLGCYVVGSAGSKEKVELLKNRFGFDEAFNYKEEQDLSAALKRYFPDGIDIYFENVGGKMLDAVLLNMRIHGRIAVCGFISQYNLEQSEGVHNLFCLITKRIRMQGFLAADYFPLYQKFVEMVTPHIKEGKVTYVEDIAEGIESAPGALVGLFSGRNVGKQLVRISRE

SEQ ID NO: 1458 - protein, 131 aa, Nicotiana tabacum
VNYLHHLNPPIVHRDLKSSNLLVDRNWTVKVGDFGLSRLKHETYLATKTGKGTPQWMAPEVLRNEPADEKSDVYSFGVILWELATEKIPWDSLNSMQVVGAVGFMNQRLDIPKNVNPQWASIIESCWHSEP

SEQ ID NO: 1459 - protein, 573 aa, Nicotiana tabacum
  misc_feature (54)..(54): Xaa can be any naturally occurring amino acid
MEEDFDIPPAEGMDEDMDLPDDPIMKVGEEKEIGNQGLKKKLVKEGEGWETPEXGDEVEVHYTGTLLDGTKFDSSRDRGDPFKFTLGQGQVIKGWDQGIKTMKKGENAIFTIPPELAYGESGSPPTIPPNATLQFDVELLSWASVKDICKDGGIFKKILAEGEKWENPKDLDEVLVKYEALLENGTVVGKSDGVEFTVQDGYFCPALAKAVKTMKKGEKVQLTVKPQYGFGEKGKPASSDGGAVPPNATLQINLELVSWKIVSSVTDDKKVVKKILKEGEGYEKPNEGAVVKLKLIGKLQDGTVFIKKGHDGENEDELFEFKTDEEQVIDGLDRAVMTMKKGEVALLTIAPEYAFGSSESKQDLAVIPPNSTVHYEVELVSFVKDKESWDMNTPEKIEAAGKKKEEGNALFKAGKYTRASKRYEKAAKFIEYDTSFSEEEKKQSKALKISCNLNNAACKLKLKDYKQAEKLCTKVLELESTNVKALYRRAQAYMNMADLDLAEFDIKKALEIDPNNRDVKLEYKALKDKVKEFNKKDAKFYGNMFAKLNKLETANSSKSAPKEPEPMSIDSKA

SEQ ID NO: 1460 - protein, 321 aa, Nicotiana tabacum
YAFNFPIQKFLQAQSIVAPSAYISAATLALHLVMSWAVIYKIGLGLLGASLILSLSWWIIVIGQFVYIVKSERCRQTWKGFSLQAFSGLPVFFKLSAASAVMLCLETWYFQVVVLLAGLLENPELSLDALSICMTISGWVFMISVGFNAAASVRVSNELGARHPKSAAFSVIVVTSWSFILSVIAAAIVLALRNLISYAFTGGEVVAAAVSDLCPLLAISLILNGIQPVLSGVAVGCGWQTFVAYVNVGCYYIVGVPVGVLLGFHFKLGAKGIWSGMLGGTVMQTIILIWITARTDWNKEVESAQYRLKKWDDKKESILEE

SEQ ID NO: 1461 - protein, 281 aa, Nicotiana tabacum
  misc_feature (23)..(23): Xaa can be any naturally occurring amino acid
  misc_feature (42)..(42): Xaa can be any naturally occurring amino acid
  misc_feature (67)..(67): Xaa can be any naturally occurring amino acid
  misc_feature (74)..(74): Xaa can be any naturally occurring amino acid
  misc_feature (79)..(79): Xaa can be any naturally occurring amino acid
  misc_feature (90)..(90): Xaa can be any naturally occurring amino acid
  misc_feature (122)..(122): Xaa can be any naturally occurring amino acid
  misc_feature (127)..(127): Xaa can be any naturally occurring amino acid
  misc_feature (130)..(130): Xaa can be any naturally occurring amino acid
MGTLRIPDVIPSPTEDCESLMKXFKGLGTNEKSVISVLGHRXASQRKKIRETYEQLYNRSLVDDIFXELSGDFXKAVIXWTYEPSERDAXLANEALKSRKKTITQLQVIVEIACASSPDHLXAVRQXYCXLFNCSLEEDITANVPMPVQKILIGLVRSYRYDKELVDPSTANAEAAILREAIRIKQLDHDNFLMILSTRNVHQLRATFECYKQNYGFSIDQDIKSCGKGLLESILKVVIWCIDTPEKHFAEVVRASIVGIGTDEDSLTRAIVTRAEVDMMK

SEQ ID NO: 1462 - protein, 258 aa, Nicotiana tabacum
MGDNSATTTAPSPAKTAAVEDALLKQFFAEVSEVERDNEVNRILSCFKLNPFDYLNLPFDSSIDEVKKQYRKLSLLVHPDKCKHPQAKEAFGALAKAQQLLLDPQERDYILNQVNAAKEELRAKRKKQLKKDTASKLKSLVTEGKFDQEHEQSEEFQHQLKLKVKEILTEQEWRRRKMAMRISEEEGRLKKDEEETKEMWKRKREHEEQWEGTREKRVSSWRDFMKGGKKVKKGEIRPPKLKTEDPNKSYVQRPVKRG

SEQ ID NO: 1463 - protein, 267 aa, Nicotiana tabacum
  misc_feature (33)..(33): Xaa can be any naturally occurring amino acid
  misc_feature (39)..(39): Xaa can be any naturally occurring amino acid
  misc_feature (57)..(57): Xaa can be any naturally occurring amino acid
MFQKELPLRGFDDEMRAAVARNLEGRGITMHPXTTLTKXEKTEDGIKVHTDHGEVIXADVVLFATGRLPNTKRLNLDAVGVELDKMQAVKVDEYSRTNVPSIWAIGDVTNRMNLTPVALMEGTCFAKTVFGRKPTKPDYSHIPCAVFCIPPLSVVGLGEEQAIEQVNGEVSVYTSTFNPMKNTISGRQEKSVMKLLVEAETDKVLGASMCGPDAPEIMQGIAIALKCGATKEQFDSTVGIHPSAAEEFVTMRSETRHVSSNKPKTNL

SEQ ID NO: 1464 - protein, 308 aa, Nicotiana tabacum
  misc_feature (144)..(144): Xaa can be any naturally occurring amino acid
ESVSPISEALKSRSDNSKISSLLECLAIITFIGGEEPEKTEKSMQLMWQVIHPKLGPNVSSAKPSPAMITAVVSSWSFLLTTMDGWTLNPKSWQGSISYFSTLLDKEDRSVRIAAGEALALVFEVGSLEKFSGEAKGSSDSSTXEANKSRELLHIQGLRAKVLNQVRTLSAEAGGKGSAKKDLNNQRNTFRDILEFLEDGYSPEASTKIGGEPLSTSTWAQLIQLNFLKHFLGGGFVKHMQENEFLHDVFGFTPKKKLPGVEHRVSGAEKRLFKSPNSEKNKARTQFLNKQRMLSQDKNVGYYTVGDV

SEQ ID NO: 1465 - protein, 198 aa, Nicotiana tabacum
  misc_feature (21)..(21): Xaa can be any naturally occurring amino acid
  misc_feature (24)..(24): Xaa can be any naturally occurring amino acid
  misc_feature (58)..(58): Xaa can be any naturally occurring amino acid
MSFQDLESGRSLGSRRGYVNXKQXPTQAVASGIFQINTAVSTFQRLVNTLGTPKDTPXLRDKLHKTRLHIGQLVKDTSAKLKQASETDHRVEVSASKKITDAKLAKDFQAVLKEFQKAQRLAAERETAYTPFVPQAVQPSIYSDGEIDVTSDKGPEQQALLDSRRQEVLLLDNEISFNEAIIEEREQGIQEVQQQIGE

SEQ ID NO: 1466 - protein, 219 aa, Nicotiana tabacum
MGVQEKDPLLQLSLPPGFRFYPTDEELLVQYLCKKVAGHDFSMQIIGDIDLYKFDPWVLPSKALFGEKEWYFFSPRDRKYPNGSRPNRVAGTGYWKATGTDKVITSQGRKVGIKKALVFYVGKAPKGTKTNWIMHEYRLFEPSRKNGSSKLDEWVLCRIYKKNSSGQKPYMSGLNSKEYSHGSSLHRRPISMICSNRYLRWITSFLTCRDWIPSEFPTR

SEQ ID NO: 1467 - protein, 455 aa, Solanum lycopersicum
MAKFIESKLEIVMFPWLAFGHLIPFMNLSNELAKRGHNITFLLPQNAETRLQKLNLYPNLIKFHKLTIPHVDGLPYGAETTADVPGPMETLLATAFDELYDEIKSILQNLKPHFVFFDFAYWIPDLAKEIGGIKTLIYLLISPAALCKSTDKATFMTSTAAELAKPPPGYPSTTVVLHESEAKLLSFVYQEYGKGVTFQERLDKALRQCDVIAAKTCREIEGIFCEYLANLLEKPVIYVGPVIPEPKKEQHELSNWLEKFEPGSVVFCAFGSQMILEKTQFQELVLGFELTELPFLLVVKPPQGTNSVEEALPEGFKQRIQEKGLILDCSVPQLEILRHKSVGCFVTHCGYGSMWESLVLCDCQLVLLPRPIDHIFTARLMGQHLKVGVEVDNDENDMFTKENLCKAVKCVMDKDSQIGCVVKENHKKWKKLLSSPGFMSNYIDNFIQDLHGLVV

SEQ ID NO: 1468 - protein, 260 aa, Solanum lycopersicum
MGDNSSVTAAPSPSSEKTSAIEDALLKQFFAEVSEVERDNEVIRILSCFKLNPFEYLNLSFDSSIDEVKRQYRKLSLLVHPDKCKHPQAKEAFGALAKAQQLLLDQQERDYILSQVVAAKEELRSKWKKQLKKDTASKLKSLVTEGKYDQEHEQSEEFQQQLKLKVREILTDQEWRRRKMAMRISEEEGRLKKDEEETKEMWKRKREHEEQWEGTREKRVSSWRDFMKGGKKAKKGEIRPPKLKTEDPNKSYVQRPVKRG

SEQ ID NO: 1469 - protein, 158 aa, Solanum lycopersicum
MSFQDLESGRSVGPRRGFMNGKQDTTQAVASGIFQINTAVSTFQRLVNTLGTPKDTPELRDKLHKTRLHIGQLVKDTSTKLKQASETDHRVEVSASKKITDAKLAKDFQAVLKEFQKAQRLAAERETAYTPFIPQAVLPSSYTDGEVDVSSDKGQEQR

SEQ ID NO: 1470 - protein, 574 aa, Solanum lycopersicum
MDDDFGIPPVEGMDEDMDLPEDSSTMKVGEEKEIGNQGLKKKLVKEGEGWETPEPGDEVEVHYTGTLLDGTKFDSSRDRGDPFKFTLGQGQVIKGWDQGIKTMKKGENAIFTIPPELAYGESGSPPTIPPNATLQFDVELLSWVSVKDICKDGGIFKKILTEGEKWENPKDLDEVLVKYEAQLENGTVVGKSDGVEFTVQDGHFCPALAKAVKTMKKGEKVQLTVKPQYGFGEKGKPASSDGGAVPPNATLQINLELVSWKTVSNVTDDKKVVKKILKEGEGYERPNEGAVVKLKLVGKLLDGTVFTKKGHDGESEDNLFEFKTDEEQVIDGLDRAVMTMKKGEAALLTIAPEYAFGSSESKQDSAVVPPNSTVHYEVELVSFLKDKESWDMSTPEKIEAAGKKKEEGNALFKAGKYARASKRYEKAAKFIEYDTNFSEEEKKQSKALKITCNLNNAACKLKLKDYKQAEKLCTKVLELDSANVKALYRRAQAYMNMADLDLAEFDIKKALEIDPDNRDVKLEYKALKEKVKEINKKDAKFYGNMFAKLNKQDSSNSANSAPKEPEPMSIDSKA

SEQ ID NO: 1471 - protein, 240 aa, Solanum lycopersicum
  misc_feature (205)..(205): Xaa can be any naturally occurring amino acid
  misc_feature (209)..(209): Xaa can be any naturally occurring amino acid
MSFQDLDSGRSSGPRRSNVNGKQDATQALASGIFQINTAVSTFQRLVNTLGTPKDTPELRDKLHKTRLHIGQLVKDTSAKLKQASETDHRIEVSASKKITDAKLAKDFQAVLKEFQKAQRLAAERETSYSPFVPQAVLPSSYTNSEIDVSSDKSQEQRALLVESRRQEVVLLDNEISFNEAIIEERDQGIQEVQQQIGEVNDIFXDLAXLVHEQGTMIDDIGSNIENSHAATAQGRTQLA

SEQ ID NO: 1472 - protein, 42 aa, Solanum lycopersicum
WEDKEKGKEVTQQWEDDWDDDDVNDDFSLQLRKELEINTEKK

SEQ ID NO: 1473 - protein, 436 aa, Solanum lycopersicum
IGQMALSKNEKRKSLLLVSSLESFLLVLLLFSIITSSLSEIFFEEQFDDDWQSRWVKSDWKRSEGKAGSFKHTAGKWAGDPDDKGIQTSTDAKHFAISAKIPEFSNKNRTLVVQYSIKLEQDIECGGGYIKLLSGYVNQKKFGGDTPYSMMFGPDICGTQTKKLHVILSYQGQNYPIKKDLQCETDKLTHFYTFILRPDASYSIWIDGRERDSGSMYTDWDIFPPRKIKDVNAKKPADWDDREYIEDPNEVKPEGYESIPKEIPNPKAKKPDHWDDEEDGIWRPPKIPNPAYKGPWKRKKVKNPNYKGKWKTPWIDNPEFEDDPDLYVLKPIKYVGIEVWQVKAGSLFDNILICDDPDYAKKVIEEVFANRETEKEAFEEAEKVRKAKEEEEAQRAREEGERRRRERDRDRGRDRHRDRNKRRYRRDYDDDYHDEL

SEQ ID NO: 1474 - protein, 43 aa, Solanum lycopersicum
  misc_feature (3)..(3): Xaa can be any naturally occurring amino acid
  misc_feature (11)..(11): Xaa can be any naturally occurring amino acid
EWXDKEKGKEXTQQWEDDWDDDDVNDDFSLQLRKELEINTEKK

SEQ ID NO: 1475 - protein, 626 aa, Solanum lycopersicum
  misc_feature (557)..(557): Xaa can be any naturally occurring amino acid
MKEKLGFLVCVWFLVIGSCLGRFVVEKNSLRVTSPDSIKNVYECAIGNFGVPQYGGTMVGIVMYPKANQKSCKDFADSDISFKTKAGGMPVFVLVDRGDCYFTLKAWNAQKAGAAAILVADDRNEPLITMDTPEEEDAKADYLQNITIPSALISQSLGDSIKKQLSKGEMVNINLDWREALPHPDERVEYEFWTNSNDECGPKCESQREFVKNFKGAAQILEQKGYTQFSPHYITWYCPEAFILSKQCKSQCINHGRYCAPDPEQDFSKGYDGKDVVLQNLRQACFYKVANDSGKPWLWWDYVTDFGIRCPMKEKKYDKECADQVITSLGFDVKQIDKCVGDPEADADNPILKAEQEAQIGKNSRGDVTILPTLVINNRQYRGKLDKGAVLKAICSGFEETTEPAICLTDDIQTNECLESNGGCWQDTAANITACRDTFRGKVCECPTVQGVKFVGDGYSHCEASGALRCGLNNGGCWKGTKDGRTYSACIDDHTKGCKCPPGFKGDGVNLCEDIDECKERLACQCPDCKCKNTWGGYQCSCSGNLLYMQEHDTCIXAGNDGKAAFSWGLVWVIILGLAVAGAGAYAVYKYRIRRYMDSEIRAIMAQYMPLDNQGEVPNHISHGNV

SEQ ID NO: 1476 - protein, 512 aa, Solanum lycopersicum
MASPENNIYRPFLQNNVTSLSPQLSETHNFESSNELETVLLDTEITLWSKLRLATWIEMKLLFFLAAPAVMVYMINYIMSMSTQIFSGHLGNLELAAASLGNTGIQVFAYGLMLGMGSAVETLCGQAFGAKKYDMLGVYLQRSTVLLTLTGILLTIVYIFCKPILIFVGQTERIAAAAALFVYGLIPQIFAYAINFPIQKFLQAQSIVAPSAYISAATLVLHLGLSWVVIFKIGLGLLGASLVLSLSWWIIVIGQFVYIVKSEKCKQTWKGFSWMAFTGLPEFFKLSAASAVMLCLETWYFQIVVLLAGLLENPEVALDALSICMSISGWVFMISVGFNAAASVRVSNELGARHPKSAAFSVVVVTSWSFILSVIAAVIVLALRNLISYAFTEGEVVAEAVSDLCPLLALSLILNGIQPVLSGVAVGCGWQTFVAYVNIGCYYIVGVPLGALLGFYFKLGAKGIWSGMLGGTVMQTIILIWITARTDWNKEVEAAQSRLKRWDDKKESILEE

SEQ ID NO: 1477 - protein, 343 aa, Triphysaria versicolor
MAEVSNKQIVLKDYVTGFPKESDMILKISTVRLKVPDGCNDVVLVKNLYLSCDPYMRPRMTKTEGSYIDSFTPGMNITGYGVAKVVDSSNPNFKKDELVWGMTGWEEYSLIKSTEGLYKVPTTDVPLSYYTGILGMPGMTAYAGFYEVCSPKKGETVYVSAASGAVGQLVGQFAKSMGCYVVGSAGSKDKVDLLKNKFGFDDAFNYKEEADLDAALKRYFPNGIDIYFENVGGKMLDAVLLNMRLHGRIAVCGMISQYNLEKPEGVHNLFNLISKRIRMEGFLVFDYYHLYPKYLEIVLPLIKDGKITYVEDLATGIESAPGALVGLFSGRNVGKQVVVVATE

SEQ ID NO: 1478 - protein, 452 aa, Triphysaria versicolor
  misc_feature (254)..(254): Xaa can be any naturally occurring amino acid
  misc_feature (275)..(275): Xaa can be any naturally occurring amino acid
  misc_feature (292)..(292): Xaa can be any naturally occurring amino acid
  misc_feature (296)..(296): Xaa can be any naturally occurring amino acid
  misc_feature (423)..(423): Xaa can be any naturally occurring amino acid
  misc_feature (437)..(437): Xaa can be any naturally occurring amino acid
  misc_feature (442)..(442): Xaa can be any naturally occurring amino acid
  misc_feature (447)..(447): Xaa can be any naturally occurring amino acid
  misc_feature (451)..(451): Xaa can be any naturally occurring amino acid
MARKMLIDGELDKTNEVESHYDFDLFVIGAGSGGVRAGRFSAQNGAKVGICELPFHPVSSEVIGGVGGTCVIRGCVPKKILVYGASYGPELEDARNYGWELNERNDFNWKKLLKKKTEEIVRLNGIYKRLLSNAGVKLYEGEGRVVGPNEVELIQLDGTKINYSAKNILIATGSRAQRPPIPGQELAITSDEALSLEELPKRAVVLGGGYIAVEFASIWRGMGSTVDLCFRKELPLRGFDDEMRAAVARNLEGXGINLHPRTTLTELVKTEHGIXVRTDHGEEIVADVVLFXTGRXPNTKRLNLEAVGVELDKTGAVKVDGYSRTNIPSIWAIGDVTNRMNLTPVALMEGTCFAKTVFGGEPTEPDYGHIPCAVFCIPPLSVVGLSEEQAIEQANGDLLVFTSSFNPMKNTISGRFRKKLGPXHAPQALRQKQDGQXRFHSXRQRAXDSSXL

SEQ ID NO: 1479 - protein, 256 aa, Triphysaria versicolor
MGDISGTTSSAAASTADDDLLLKKFFAEVGEVERDNEVNRILSCFKLNAFEYLNLPFDSSIDEVKRQYRKLSLLVHPDKCKHPQAKDAFGALAKAQQLLLDPQERDYILNQVTAAKAELRSKRKKQLKKNTANKLKSLVDEGKYEQEYERSEAFQQQLKMKVREILTDQEWRRRKMQMRISEEEGRLKKDEEETKEMWKRKREHEEQWEGTREKRVSSWRDFMKGGKKTAKGELRPPKLKTEDPNKSYVQRPVKRG

SEQ ID NO: 1480 - protein, 179 aa, Triphysaria versicolor
YYTGILGMPGMTAYAGFYEVCSPKKGETVYVSAASGAVGQLVGQFAKSMGCYVVGSAGSKDKVDLLKNKFGFDDAFNYKEEADLDAALKRCFPNGIDIYFENVGGKMLDAVLLNMRLHGRIAVCGMISQYNLEKPEGVHNLFNLISKRIRMEGFLVFDYYHLYPKYLEIVLPLIKDGKI

SEQ ID NO: 1481 - protein, 428 aa, Triphysaria versicolor
  misc_feature (9)..(11): Xaa can be any naturally occurring amino acid
  misc_feature (20)..(20): Xaa can be any naturally occurring amino acid
QLWQRLSYXXXASILLVLIXSLFCSSFAEIIFEERFEGGWQDRWVKSDWKRSEGKAGSFKHSAGKWHGDPDDRGIQTTTDARHFAISAKIPEFSNKNRTLVVQYSIRLEQDIECGGGYIKLLSGYVNQKKFGGDTPYSMMFGPDICGTQTKKLHVILSYQGQNYPIKKDLQCETDKLTHFYTFVLRPDASYSVLVDGRERDSGSMYTDWDILPPRKIKAVNAKKPADWDDREYINDPSAAKPEGYDSIPREIPDPKAKEPYDWDEDDDGIWKAPKIPNPAYKGPWKAKKIKNPNYKGKWKIPYIDNPEFEDDPDLYVLKPIKYVGIEVWQVKAGSVFDNILISDDPDYAKNVVNEVFANREAEKEAFEEAEKVRKAKEDEEAQRAREEGERRRRERGDDRRHRDRERHRDRYRKHRRDYMDDDYHDEL

SEQ ID NO: 1482 - protein, 496 aa, Triphysaria versicolor
  misc_feature (254)..(254): Xaa can be any naturally occurring amino acid
  misc_feature (275)..(275): Xaa can be any naturally occurring amino acid
  misc_feature (292)..(292): Xaa can be any naturally occurring amino acid
  misc_feature (296)..(296): Xaa can be any naturally occurring amino acid
MARKMLIDGELDKTNEVESHYDFDLFVIGAGSGGVRAGRFSAQNGAKVGICELPFHPVSSEVIGGVGGTCVIRGCVPKKILVYGASYGPELEDARNYGWELNERNDFNWKKLLKKKTEEIVRLNGIYKRLLSNAGVKLYEGEGRVVGPNEVELIQLDGTKINYSAKNILIATGSRAQRPPIPGQELAITSDEALSLEELPKRAVVLGGGYIAVEFASIWRGMGSTVDLCFRKELPLRGFDDEMRAAVARNLEGXGINLHPRTTLTELVKTEHGIXVRTDHGEEIVADVVLFXTGRXPNTKRLNLEAVGVELDKTGAVKVDGYSRTNIPSIWAIGDVTNRMNLTPVALMEGTCFAKTVFGGEPTEPDYGHIPCAVFCIPPLSVVGLSEEQAIEQANGDLLVFTSSFNPMKNTISGRTEKTVMKLVVDAETDKVIGASMCGPDSPEIMQGIAIALKCGATKAQFDSTVGIHPSAAEEFVTMRTVSRRIAAAGKPKTNL

SEQ ID NO: 1483 - protein, 274 aa, Triphysaria versicolor
  misc_feature (92)..(92): Xaa can be any naturally occurring amino acid
  misc_feature (174)..(174): Xaa can be any naturally occurring amino acid
MSFQDLESGRGVGLRRGYVNGKQDPTQAVASGIFQINTAVSTFHRLVNTLGTPKDTPELREKLHKTRLHIGQLVKDTSAKLKQASETDHNIXVSASKKITDAKLAKDFQAVLKEFQKAQRLAAERETAYTPFVPQSVLPSSSYSAGDVDISTDKNPEQRALLVESRRQEVVLLXNEIAFNEAIIEERDQGIQEIQQQIGEVNEIFKDLAVLVHEQGTMIDDIGSNIEGSHAATAQAKSQLVKASKTQRSNSSLTCLLLVIFGIVLLIVIIVLAA

SEQ ID NO: 1484 - protein, 208 aa, Triticum aestivum; identical to SEQ ID NO: 1349

SEQ ID NO: 1485 - protein, 501 aa, Triticum aestivum
MARKMLKDGEAPAVADADGGGGEGSYDYDLFVIGAGSGGVRGSRTAAGFGAKVAICELPFHPISSEWLGGHGGTCVIRGCVPKKILVYGASFRGEFDDAKQFGWEINGDINYNWKKLLENKTQEIVRLNGVYKRILGGSGVTMIEGAGSIVDAHTVEVTQPDGSKQRHTTKHILIATGSRATLVDIPGKELAITSDEALSLEELPKRAVILGGGYIAVEFASIWKGLGAEVDLFYRKELPLRGFDDEMRTVVASNLEGRGIRLHPGTNLTELSKTADGIKVVTDKGDELIADVVLFATGRAPNSNRLNLEAVGVEVDQIGAIKVDEYSRTSVPSIWAVGDVTNRINLTPVALMEATCFAKTVFGGQTVKPDYKDVPCAVFCIPPLSVVGLSEQEALAEAKNDLLVYTSSFNPMKNSISKRVEKSTMKLVVDAETDKVLGAAMCGPDAAEIMQGIAVALKAGATKATFDSTVGIHPSAAEEFVTMRTLTRRVSPPSKPKTNL

SEQ ID NO: 1486 - protein, 177 aa, Triticum aestivum
MASCPSVKNILVLDAEGKRVAVKYYADDWPSASSKLAFEKSLFVKTQKTSARTEADVVMFDGYIIVYKFIQDLHFFVTGGDEENELILASVLQGFSDAVGILLRNSVDKRTALENLDLIFLCLDEVVDGGIVLETDGNVIAEKVSGHGLEGAGSFTEQTISQALATAREHFARSLLK

SEQ ID NO: 1487 - protein, 345 aa, Triticum aestivum
TAAACASSLLAPPSASCAGPAASGALFPTSVPSLRAYPRLLLAFRRPAAAAVADPQGAAVLEEEEDEAPVQFDDVDEDYEDGYGGRGPAFTAPTRPRTGKAALPLKRDRTRSKRYLEIQKLRESKKEYDVPMAISLMKQVANTRFVESAEAHFRMNLDPKYNDQQLRATVNLPKGTGQTVKIAVLTQGEKIDEARAAGADIVGSDDLIEQIKGGFMEFDKLIASPDMMPKVASLGKILGPRGLMPNPKAGTVSPNITQAIDEFKKGKVEFRVDKTGIAHIPFGKVNFPEEDLIANFMAVVRSIERNKPSGAKGIYWKTAYVCSSMGPSIKLNIKEMLDYGADSSN

SEQ ID NO: 1488 - protein, 193 aa, Triticum aestivum
MKIQCDSCGVAAATVVCCADEAALCARCDVDIHAANKLASKHQRLPLDALGAKLPRCDICQEKAAFIFCVEDRALFCRDCDEPIHVPGTLSGNHQRYLATGIRVGLGPVSACAAGDHGASHDADHPAPPKLACEPQPPAQPAASAQQVPSPPQFLPQDWGVDELLQFSDYESSDKLHKDSALGFKELEWSPRT

SEQ ID NO: 1489 - protein, 177 aa, Triticum aestivum
MHPFDVGDRCEIEEVQVVVEEMNIMTTIFLRYDNLKIYYPNSVLATKPIFNFYRSPDMGEGVDFSVHVATPLEKLALMKERILRYIDSKKEHWYPGAMVVLRDVDDTNKLKVSIWLRHTLNFQDMGMRFVRRELVLQEMIRVLKDLNIEYRMLPLDVNVRNAPPLQSTRMPTTWNYS

SEQ ID NO: 1490 - protein, 239 aa, Triticum aestivum
LPRRRREPHPAESPSAPPRRRRRPPPALDGMGSGSRAASCLCCPFKCLACGLFSCLCSILVSLLVTAGVLALILYFIFRPQMIAATVDSASLAQFALGTPASPALLQYNLTLAMTVRNPNKRVGLYYDNVEALALYDGQRFGFAPLDPFFQGHQASTEVKPAFGGQQVLEGDVTQSNLRTQLSGGAVEVEVKLNAKLRVKVWAFKVPGPRARISCPLSLPAPAAAGAPAFKPTECKVWF

SEQ ID NO: 1491 - protein, 246 aa, Triticum aestivum
RAEFGTSSAGSHYLLLFSGEPPAMGSSRRRGDRQLLHRLLALSSLLLLASGEVIFEERFEDGWETRWVKSDWKRSEGKAGTFKHTAGKYSGDPDDKGIQTTIDARHFAISAKIPEFSNKGRTLVVQYSIKFEQEIECGGGYIKLMSGYVNQKKYSGDTPYSLMFGPDICGTQTKKLHLILSYQGQNYPIKKDLQCETDRLTHVYTFILRPDASYSLLVDNRERESGSMYTDWDILPPRKIKDVGAK

SEQ ID NO: 1492 - protein, 253 aa, Triticum aestivum
  misc_feature (4)..(4): Xaa can be any naturally occurring amino acid
SPTXIPPARLATNHPNPIHQATNSPLSPSNLPQLLLAAHHQLDGMGSGSRAASCLCCPFKCLACGLFSCLCSILVSLLVTAGVLALILYFVFRPQMIAATVDSASLAQFALGTPASPALLQYNLTLAMTVRNPNKRVGLYYDGVEALALFDGQRFGFAPLDPFFQGHQASTEVKPAFGGQQVLEGDVTQANLRTQLAGGAVEVEVKLNAKLRVKVWAFKVPGPRARISCPLSLPVPAAANAPAFKPTECKVWF

SEQ ID NO: 1493 - protein, 352 aa, Triticum aestivum
EAPRHGTAAACASSLLAPPSASCAAGPAASGALFPTSVPSLRAYPRLLLAFRRPAAAAVADPQGAAVLEEEEDEAPVQFDDIDEDYEDGYGGRGPAFTAPTRPRTGKAALPLKRDRTRSKRYLEIQKLRESKKEYDVPMAISLMKQVANTRFVESAEAHFRMNLDPKYNDQQLRATVNLPKGTGQTVKIAVLTQGEKIDEARAAGADIVGSDDLIEQIKGGFMEFDKLIASPDMMPKVASLGKILGPRGLMPNPKAGTVSPNITQAIDEFKKGKVEFRVDKTGIAHIPFGKVNFPEEDLIANFMAVVRSIERNKPSGAKGIYWKTAYVCSSMGPSIKLNIKEMLDYGADSSN

SEQ ID NO: 1494 - protein, 103 aa, Triticum aestivum
  misc_feature (10)..(10): Xaa can be any naturally occurring amino acid
  misc_feature (12)..(13): Xaa can be any naturally occurring amino acid
RISKLRLNHXVXXSNTMKEQLKESRIKILATLLVFAMVTEGLAIRVNGTVRNDITGEGVSTKTTLGAGSSTTVDNHHAIPRDQYSSHGGEDGSDGSGGDTTKN

SEQ ID NO: 1495 - protein, 496 aa, Triticum aestivum
MARKMLKDGEAPVVADDGGSYDYDLFVIGAGSGGVRGSRTAAGFGAKVAICELPFHPISSEWLGGHGGTCVIRGCVPKKILVYGASFRGEFDDAKQFGWEINGDINYNWKKLLENKTQEIVRLNGVYKRILGGSGVTMIEGAGSIVDAHTVEVTQPDGSKQRHTTKHILIATGSRATLVNIPGKELAITSDEALSLEELPKRALILGGGYIAVEFASIWKGLGAEVDLFYRKELPLRGFDDEMRTVVASNLEGRGIRLHPGTNLTELSKTADGIKVVTDKGDELIADVVLFATGRAPNSNRLNLEAVGVEVDQIGAIKVDEYSRTSVPSIWAVGDVTNRINLTPVALMEATCFAKTVFGGQTVKPDYKDVPCAVFCIPPLSVVGLSEQEALAETKNDLLIYTSSFNPMKNSISKRVEKSTMKLVVDAETDKVLGAAMCGPDAAEIMQGIAVALKAGATKATFDSTVGIHPSAAEEFVTMRTLTRRVSPPSKPKTNL

SEQ ID NO: 1496 - protein, 246 aa, Triticum aestivum; identical to SEQ ID NO: 312

SEQ ID NO: 1497 - protein, 224 aa, Triticum aestivum
GEKRKRSSRARATTTTTTPAAATMSPLRALLVLAAVLAACLGPAAADQPGSVEGYTIAGRIKIDAARGFGLPAKTSNTKVILNGGQKVTFARPDGYFAFHNVPAGTHLIEVSSLGYFFSPVRVDISARNPGHIQAALTENRRVLNELVLEPLKEEQYYEPREPFNILSLLKSPMGMMVGFMVLMVVVMPKMMENIDPEEIKQAQEQMRNSPVPSFSGLLARANS

SEQ ID NO: 1498 - protein, 118 aa, Triticum aestivum
MAMRPLVVLALAVALAGVALRGGAAEGAGECGRSSPDRMALRMAPCISAADEPDSAPSSSCCSAVHTLGKSPSCLCAVMLSGTAKMAGIKPEVAITIPKRCNMADRPVGYKCGDYTLP

SEQ ID NO: 1499 - protein, 386 aa, Triticum aestivum
  misc_feature (33)..(33): Xaa can be any naturally occurring amino acid
  misc_feature (43)..(43): Xaa can be any naturally occurring amino acid
  misc_feature (46)..(46): Xaa can be any naturally occurring amino acid
  misc_feature (58)..(59): Xaa can be any naturally occurring amino acid
  misc_feature (81)..(81): Xaa can be any naturally occurring amino acid
MATAVFAGEGTAARGGCSAECAGGIERPPDLGXRARAAGDGCXKRXVYLMECVPLWGXXAARGRAAEMEDACAAVPRFAAXPARMLASSRELDGIGGDFDAAELRLPAHLFGVYDGHGGSEVANYCRDKIHVVLREVLKAGRWLEELGEVGELDVKEPWEKVFGDCFQKVDDEVSGKASRFSNGTREIRPEPIAADNVGSTAVVAIVCSSHVITANCGDSRVVLCRGKEPIALSVDHKPDRKDERARIEAAGGKVIDWNGYRVSGILAMSRSIGDRYLKPFLIPKPEVSIVARAKDDDCLILASDGLWDVMSNEDACKVARRQILLWYKNNNDGANSDGGSEPTMNPAAKAAADCLVRLALSKGSGDNISVIVIDLKSRKKTKGKT

SEQ ID NO: 1500 - protein, 245 aa, Triticum aestivum
  misc_feature (17)..(17): Xaa can be any naturally occurring amino acid
  misc_feature (19)..(19): Xaa can be any naturally occurring amino acid
PRPDLAAAVPLLLAVAXGXTLPGATSTSSTSKASRLTLAMGSGSRAASCLCCPFKCLACGLFSCLCSILVSLLVTAGVLALILYFVFRPQMIAATVDSASLAQFALGTPASPALLQYNLTLAMTVRNPNKRVGLYYDNVEALALYDGQRFGFAPLDPFFQGHQASTEVKPAFGGQQVLEGDVTQSNLRTQLAGGAVEVEVKLNAKLRVKVWAFKVPGPRARISCPLSLPAAGAPAFKPTDCKVWF

SEQ ID NO: 1501 - protein, 577 aa, Triticum aestivum
MAASSPTPGGGLGAILAAGDRDYLIRNSGEQVKISSIEGDTVAIYFSASWCPPCQRFTPKLIEAYKELTSHGKSFEVIFVSGDQDEEAFNAYFAKMPWLAVPFSDSEGRKSLDERFEVNGIPHLVFLDAKTGEVLTDEGVEFVSEYGIEAYPFTTERINELKEQEKAAKDNQTIHSVLATPNRNYVISNTGEKVPIVDLEGKYVGICFVVNGYPPVEEFTPVLAKIYAKLKEVGEKFEVVAVSLDSDEESFNNSFSSMPWLAIPQGDKMCQKLVSYFELSDLPTLVLIGPDGKTLSSNIADIINEHGLDAWEGFPFNAEKLEILAEKAKAKAASQTLESLLVTGDVDFVIGKDGAKVPVAELVGKTVLLYFSAKWCGPCRAFLPTLVDVYNKIKEKNSDFEIVFISSDRDQSSFDDFFSGMPWLAIPLEDERKAYLKKKFKIRGIPSLVAIGPDGKTVNTDAKTSLAVHGADAFPFTSERIQELEKKIDEMAKGWPEKVKHELHEHELVLIRRPRPYGCDGCEEMGTSWSYNCAECDFDLHAKCALGEEKKGEEVNGQEHAAAPAGYVCEGDVCRKA

SEQ ID NO: 1502 - protein, 170 aa, Triticum aestivum
ELEERERKHYSSKDKSYSEERDRRKSSSQLLLEGSKREAEDKIVPREIDADDSDVEPKSDDESDEDDDDDDDTEALMAELERIKKERAEEKLRKERQQAEEEAKMKEAELMRGNPLININNPGSFSVKRRWDDDVVFKNQARGETKTPKRFINDTIRSDFHRKFLQRYMK

SEQ ID NO: 1503 - protein, 83 aa, Triticum aestivum
  misc_feature (54)..(54): Xaa can be any naturally occurring amino acid
MAAAPADAKAEAAKMDLLEDDDEFEEFEIDQEWDDQEEGNEAVQQWEDDWDDDXVNDDSRCSLRKSWTEATARRAEVLFLYFI

SEQ ID NO: 1504 - protein, 404 aa, Triticum aestivum
  misc_feature (69)..(69): Xaa can be any naturally occurring amino acid
  misc_feature (71)..(71): Xaa can be any naturally occurring amino acid
  misc_feature (84)..(84): Xaa can be any naturally occurring amino acid
  misc_feature (97)..(97): Xaa can be any naturally occurring amino acid
RVDPRVRDLPVREAGGGSLASAEMAAAAAICGEDEPAPRDPESAAAAGGGVERLDLGDGRAALVAGGKXSXYLMDCEPVWGCVXTPGRGGEMEDACXAVPRFADVPVRLLARRRDLEGLGLDADALRLPSHLFAVFDGHGGSEVSNYCRERLHVVLSKELRRPPSDLGEMSDVDMKEHWDDLFTRCFQTVDDEVSGLASRLVHGQPRSDPIAAENVGSTAVAVVVCSSHVVVANCGDSRIVLSRGKEPVALSIDQKPDRKDERARIEAAGGKVIQWNGHRVSGILAMSRSIGDRYLKPYIIPKPEVTIVPRAKDDDCLILASDGLWDVVSNEEACKVARRQIQQWHKNNSVTTSSSDGGDGSTDPAAQAAADYLTRLALKKGSQDNITVIVVDLKPRRKPKNNS

SEQ ID NO: 1505 - protein, 229 aa, Triticum aestivum
MNIFKKKVDPKEALRTSKREMSVATRGVEREIGSLQMEEKKLVAEIKKTAKTGNEAATKILARQLVRLRQQIVNLQGTRAQIRGVATHTQAMYAGTSISAGMKGASKAMAAMNKQLEPTKQMKQMREFQKQSSQLDMTLEMMSDAIDETLDKDEAEEETEELTNQVLDEIGVDVASQLSSAPKGRIGASNKKAENNQARNAAPAKNVAPEPNAAEVDDLERRLASLRRI

SEQ ID NO: 1506 - protein, 229 aa, Triticum aestivum
DVKEPWEKVFGDCFQKVDDEVSGKASRLSNGRPEPIAADNVGSTAVVAIVCSSHVITANCGDSRVVLCRGKEPIALSVDHKPDRKDERARIEAAGGKVIDWNGYRVSGILAMSRSIGDRYLKPFLIPKPEVSIVARAKDDDCLILASDGLWDVMSNEDACKVARRQILLWYKNNNDGANSDGGSEPTMNPAAKAAADCLVRLALSKGSGDNISVIVIDLKSRKKPKGKS

SEQ ID NO: 1507 - protein, 225 aa, Triticum aestivum
TVERREEKRSSRARETTTTSAAATMSPLRALLVLAAVLAACLGPAAADQPGSVEGYTIAGRIKIDAARGFGLPAKTSNTKVILNGGQKVTFARPDGYFAFHNVPAGTHLIEVSSLGYFFSPVRVDISARNPGHIQAALTENRRVLNELVLEPLKEEQYYEPREPFNILSLLKSPMGMMVGFMVLMVVVMPKMMENIDPEEIKQAQEQMRNSPVPSFSGLLARANS

SEQ ID NO: 1508 - protein, 217 aa, Triticum aestivum
RSSRARETTTTSAAATMSPLRALLVLAAVLAACLGPAAADQPGSVEGYTIAGRIKIDAARGFGLPAKTSNTKVILNGGQKVTFARPDGYFAFHNVPAGTHLIEVSSLGYFFSPVRVDISARNPGHIQAALTENRRVLNELVLEPLKEEQYYEPREPFNILSLLKSPMGMMVGFMVLMVVVMPKMMENIDPEEIKQAQEQMRNSPVPSFSGLLARANS

SEQ ID NO: 1509 - protein, 246 aa, Triticum aestivum
AHQSTPTSPSPEIPSSRTTPQVLPAAAVVVHHQLARMGSGSRAASCLCCPFKCLACGLFSCLCSILVSLLVTAGVLALILYFIFRPQMIAATVDSASLAQFALGTPASPALLQYNLTLAMTVRNPNKRVGLYYDNVEALALFDGQRFGFAPLDPFFQGHQASTEVKPAFGGQQVLEGDVTQSNLRSQLAGGAVEVEVKLNAKLRVKVWAFKVPGPRARISCPLSLPAPGAAAGAPAFKRTECKVWF

SEQ ID NO: 1510 - protein, 316 aa, Triticum aestivum
  misc_feature (62)..(62): Xaa can be any naturally occurring amino acid
  misc_feature (182)..(182): Xaa can be any naturally occurring amino acid
  misc_feature (238)..(238): Xaa can be any naturally occurring amino acid
MAAKKIFHNVAKHRSKYIYLADLMHFMRQEEAIKAMHLFEGGQEYNRISKRSLKNWMVNAFXERKALALTLNDTKVAVSKLNQMTNVVGGIIVFVLWLLILGIATTNLLVFLSSPFLVAVIVFGDTLKAVFEAIVFLFVMHPFDVGDRCEIEEVQVVVEEMNILTTVFLRYDNLKIYYPNNXLATIPIMNFYRSPDMGEGIDFYIHVATPVAKLALMKERILRYINNKKEHWYPGAMXVLRDVDETNKLKVSIWLCHTLNFQDMGMRYVRRELVLQEMIKVLRDLDIEYRMLPLDVNVRNVPPIESTRMPTTWNYS

SEQ ID NO: 1511 - protein, 239 aa, Triticum aestivum
SSPSPPESPPSRPTTAATGTSSKSDQLYSMGSGSRAASCLCCPFKCLACGLFSCLCSILVSLLVTAGVLALILYFVFRPQMIAATVDSASLAQFALGTPASPALLQYNLTLAMTVRNPNKRVGLYYDGVEALALFDGQRFGFAPLDPFFQGHQASTEVKPAFGGQQVLEGDVTQANLRSQLAGGAVEVEVKLNARLRVKVWAFKVPGPRARISCPLSLPAPGAAAGAPAFKPTECKVWF

SEQ ID NO: 1512 - protein, 109 aa, Triticum aestivum
  misc_feature (3)..(3): Xaa can be any naturally occurring amino acid
  misc_feature (17)..(17): Xaa can be any naturally occurring amino acid
RNXTYNTIQTSIESQGXDFPDTMKEQLKASRIKILAALLVFAMVTQGLAIRVKGTVRNDITDEAVSAKTTLGAGSSTTVDNHHAIPRDQYSSHGGEDGSGGSGGDTTKN

SEQ ID NO: 1513 - protein, 444 aa, Triticum aestivum
RESLPHPDERVEYEFWTNSNDECGPKCDSQIDFVKSFKGPAQILEKKGYTQFTPHYITWYCPEAFTLSKQCKSQCINHGRYCAPDPEQDFSKGYDGKDVVVQNLRQVCVYKVAKENKKPWLWWDYVTDFAIRCPMKEKKYTKECADGVIKSLGLDHKAIDKCIGDPNADEENPVLKAEQDAQIGKGARGDVTILPTLVINNRQYRGKLDKGAVLKALCAGFQETTEPAVCLSEDIQTNECLENNGGCWHDKAANISACKDTFRGRVCECPVVKGVKFVGDGYTHCEASGSGRCEINNGGCWKETRNGRTHSACTDGGCKCPDGFKGDGVHKCEDVDECKERTACQCKECKCKNTWGSYECGCGGGLLYMKEHDTCISKDAGARVGWNFLWFLLFGLAAVGIAGYAVYKYRIRSYMDSEIRAIMAQYMPLDNQGEIPNHSHHIEM

SEQ ID NO: 1514 - protein, 371 aa, Triticum aestivum
  misc_feature (11)..(11): Xaa can be any naturally occurring amino acid
  misc_feature (62)..(62): Xaa can be any naturally occurring amino acid
MLCSERLSSVXEFTPVLAKIYAKLKEVGEKFEVVAVSLDSDEESFNNSFSSMPWLAIPQGDXMCQKLVSYFELSDLPTLVLIGPDGKTLSSNIADIINEHGLDAWEGFPFNAEKLEILAEKAKAKAAAQTLESLLVTGDIDFVIRKDGAKVPVVELVGKTVLLYFSAKWCGPCRAFLPTLVDVYNKIKEKNSDFEIVFISSDRDQSSFDDFFSGMPWLAIPLEDDRKAYLKKKFKIRGIPSLVAIGPDGKTVNTDAKTSLAVHGADAFPFTSERIQELEKKIDEMAKGWPEKLKHELHEHELLLIRRPRPYGCDGCEEMGTSWSYNCAECDFDLHTKCALGEEKKGEEVKGQEDAAAPAGYVCEGDVCRKA

SEQ ID NO: 1515 - protein, 177 aa, Triticum aestivum
  misc_feature (109)..(109): Xaa can be any naturally occurring amino acid
MASCPSVKNILVLDAEGKRVAVKYYADDWPSASSKLAFEKSLFVKTQKTSARAEADVVMFDGYIIVYKFIQDLHFFVTGGDEENELILASVLQGFSDAVGILLRNNVDXRTALENLDLIFLCLDEVVDGGIVLETDGNVIAEKVSGHGLEGAGSFTEQTISQALATAREHFARSLLK

SEQ ID NO: 1516 - protein, 118 aa, Triticum aestivum
MAMRPLVVLALAVALAGVALGGGAAEGAGECGRSSPDRMALRMAPCISAADEPDSAPSSSCCSAVHTIGKSPSCLCAVMLSGTAKMAGIKPEVAITIPKRCNMADRPVGYKCGDYTLP

SEQ ID NO: 1517 - protein, 177 aa, Triticum aestivum
METCPSVKNILLLDSEGKRVAVKYYTDDWPVLSAKLAFEKSVFVKTQKASSGAEAEIVMFDGQIVVYKFIQDLHFFVTGGDEDNELILASVLQGFADAIDIILRNNVDKRTALENLDLILLCLDEIVDGGIVLETEGSVIAEKVLAHGAEGATSIAEQTIVQALTTAREHFAKSLLM

SEQ ID NO: 1518 - protein, 118 aa, Triticum aestivum
MAMRPLVVLALAVALAGVALGGGAAEGAGECGRASPDRMALRMAPCISAADEPDSAPSSSCCSAVHTIGKSPSCLCAVMLSGTAKMAGIRPEVAITIPKRCNIADRPVGYKCGDYTLP

SEQ ID NO: 1519 - protein, 292 aa, Triticum aestivum
GPDGKTLSSNIADIINEHGLDAWEGFPFNAEKLEILAEKAKAKAAAQTLESLLVTGDIDFVIGKDGAKVPVAELVGKTVLLYFSAKWCGPCRAFLPTLVDVYNKVKEKNSDFEIVFISSDRDQSSFDDFFSGMPWLAVPLEDDRKAYLKKKFKIRGIPSLVAIGPDGKTVNTDAKTSLAVHGADAFPFTSERIQELEKKIDEMAKGWPEKVKHELHEHELVLIRRPRPYGCDGCEEMGTSWSYNCAECDFDLHTKCALGEEKKGDEVNGQDAAAEAAAPAGYVCEGDVCRKA

SEQ ID NO: 1520 - protein, 192 aa, Triticum aestivum
KKQYRKLSLLVHPDKCKHPQAQEAFGALAKAQQLLLDPQERGYILDQVTSAKEELRAKRKKELRKDSASKIKSQVDEGKYEEQFERSDEFQKQLIIKVREILTDKEWRRRKMQMRISEEEGRLKKDEEETKEMWKRKREHEEKWEETRDQRVSSWRDFMKTGKKARKGELKPPRLKTEDPNKSYVQRPVKRG

SEQ ID NO: 1521 - protein, 177 aa, Triticum aestivum
MGSCPSVKNILVLDAEGKRVAVKYYADDWPSAASKLAFEKSLFVKTQKTSARAEADVVMFDGYIIVYKFIQDLHFFVTGGDEENELILASVLQGFSDAVGVLLRNNVDKRTALENLDLIFLCLDEVVDGGIVLETDGNVIAEKVSGHGLEGAGSFTEQTISQALATAREHFARSLLK

SEQ ID NO: 1522 - protein, 218 aa, Triticum aestivum
QQQQPARLARMGSGSRAASCLCCPFKCLACGLFSCLCSILVSLLVTAGVLALILYFLFRPQMIAATVDSASLAQFQLSQANPALLQYNLTLAMTVRNPNKRVGLYYDGVEALALFDGQRFGFAPLDPFFQGHQASTEVKPAFGGQQVLEGDVTQANLRSQLAGGAVEVEVKLNAKLRVKVWAFKVPGPRARISCPLSLPAPAAANAPAFKPTECKVWF

SEQ ID NO: 1523 - protein, 261 aa, Triticum aestivum
  misc_feature (69)..(69): Xaa can be any naturally occurring amino acid
  misc_feature (71)..(71): Xaa can be any naturally occurring amino acid
  misc_feature (84)..(84): Xaa can be any naturally occurring amino acid
  misc_feature (97)..(97): Xaa can be any naturally occurring amino acid
RVDPRVRDLPVREAGGGSLASAEMAAAAAICGEDEPAPRDPESAAAAGGGVERLDLGDGRAALVAGGKXSXYLMDCEPVWGCVXTPGRGGEMEDACXAVPRFADVPVRLLARRRDLEGLGLDADALRLPSHLFAVFDGHGGSEVSNYCRERLHVVLSKELRRPPSDLGEMSDVDMKEHWDDLFTRCFQTVDDEVSGLASRLVHGQPRSDPIAAENVGSTAVAVVVCSSHVVVANCGDSRIVLSRGKEPVALSIDQKVDMVL

SEQ ID NO: 1524 - protein, 623 aa, Triticum aestivum
GRVGWNRSAENLYGYPASEVLGQDALMLLVDSRDLSVVNDMFRRISLGESWTGKFPVKNKAGDRFLAVGTNTPFYDEDGSLVGIICVSSDSRALEEILSGPSTSARSHSESSSPSCCDGSCSNSNRKASLLNRNPFDPQQSTIASKITNLANKVTNKVRSRVKMDENGMVREGGSGESQCSDRDNKEGPSSGPSTPRGDAPHGAFGTEENSPGKSTKTNGDESEAKIGLHKILSSKAEALLNKKGITWPWKGRENDGPDCRNQVTWPSLHGEQENGQNHPKISDTQVAEFNQPNKNEASGSWSSFNNNSSSSASSTGSTNSSALYKIDHEADCLDYEILWEDLVIGEQVGQGSCGTVYHALWYGSDVGVKVFSRQEYSEEVIQAFRQEVSLMKKLRHPNILLFMGAVTSPHRLCIVTEFLPRGSLFRLLQRSTTKLDWRRRVHMALDVARGMNYLHHYSPPIIHRDLKSSNLLVDKNWTVKVADFGLSRLKRETYLTTKTGKGTPQWMAPEVLRNEPSDEKSDVYSYGVILWELVTQKIPWENLNSMQVIGAVGFMNQRLEIPSETDPYWTSLILSCWETDPQSRPSFQELLEKLRELQRKYAVQNQVQRNASAAAKNSIIEE

SEQ ID NO: 1525 - protein, 496 aa, Triticum aestivum
MARKMLKDGEAPLVADDGGTYDYDLFVIGAGSGGVRGSRTAAGFGAKVAICELPFHPISSEWLGGHGGTCVIRGCVPKKILVYGASFRGEFDDAKQFGWEINGDINYNWKKLLENKTQEIVRLNGVYKRILGGSGVTMIEGAGSIVDAHTVEVTQPDGSKQRHTTKHILIATGSRATLVDIPGKELAITSDEALSLEELPKRAVILGGGYIAVEFASIWKGLGAEVDLFYRKELPLRGFDDEMRTVVASNLEGRGIRLHPGTNLTELSKTADGIKVVTDKGDELIADVVLFATGRAPNSNRLNLEAVGVEVDQIGAIKVDEYSRTSVPSIWAVGDVTNRINLTPVALMEATCFAKTVFGGQTVKPDYKDVPCAVFCIPPLSVVGLSEQEALAEAKNDLLVYTSSFNPMKNSISKRVEKSTMKLVVDADTDKVLGAAMCGPDAAEIMQGIAVALKAGATKATFDSTVGIHPSAAEEFVTMRTLTRRVSPPSKPKTNL

SEQ ID NO: 1526 - protein, 177 aa, Triticum aestivum
METCPSVKNILLLDSEGKRVAVKYYTDDWPVLSAKLAFEKSVFVKTQKASSGAEAEIVMFDGQIVVYKFIQDLHFFVTGGDEDNELILASVLQGFADAIDIILRNNVDKRTALENLDLILLCLDEIVDGGVVLETEGSVIAEKVLAHGAEGATSIAEQTIVQALTTAREHFAKSLLM

SEQ ID NO: 1527 - protein, 177 aa, Triticum aestivum
METCPSVKNILLLDSEGKRVAVKYYTDDWPVLSAKLAFEKSVFVKTQKASSGAEAEIVMFDGQIVVYKFIQDLHFFVTGGDEDNELILASVLQGFADAIDIILRNNVDKRTALENLDLILLCLDEIVDGGIVLETEGSVIAEKVLAHGAEGTTSIAEQTIVQALTTAREHFAKSLLM

SEQ ID NO: 1528 - protein, 345 aa, Triticum aestivum
VGEKFEVVAVSLDSDEESFNNSFSSMPWLAIPHGDKMCQKLVSYFELSDLPTLVLIGPDGKTLSSNIADIINEHGLDAWEGFPFNAEKLEILAEKAKAKAASQTLESLLVTGDVDFVIGKDGAKVPVAELVGKTVLLYFSAKWCGPCRAFLPTLVDVYNKIKEKNSDFEIVFVSSDRDQSSFDDFFSGMPWLAIPLEDERKAYLKKKFKIRGIPSLVAIGPDGKTVNTDAKTSLAVHGADAFPFTDERIQELEKKIEEMAKGWPEKLKHELHEHELVLIRRPRPYGCDGCEEMGTSWSYNCAECDFDLHTKCALGEEKKGEEVNGQEHAAAPAGYVCEGDVCRKA

SEQ ID NO: 1529 - protein, 259 aa, Triticum aestivum
VAVKVFSRQEYSEEMIRTFRQEVSLMKKLRHPNIILFMGAVASQERLCIVTEFLPRGSLFRLLRKTTGKLDPRRRVHMAIDIARGMNYLHSSSPTVVHRDLKSSNLLVDKNWTVKVADFGLSRLKIETFLTTKTGKGTPQWMAPEVLRNEPSNEKSDVYSYGVVLWELVTQKIPWDTLNTMQVIGAVGFMDHRLEIPSDIDPQWASMIESCWDSDPQRRPSFQELLERLRELQKKYALQVQMQRSAAGKGAEKMSVDDG

SEQ ID NO: 1530 - DNA, 849 bp, Artificial sequence
  Cloned MAB1
agactccgttcggagaaaaggattcagcttgtgggcagaagaagaagaagaagatggcttccgcgaaatccggggagagggggagcagcagcttcgccatggcctgcagcctgctcagccgctacgtcaggcagaacggcgcagccgccggcgagctcggcctcggcatcagaggtgaagccgatgcgaacaaggggaaggagaccatggagctgttcccccagaattccgggttcggctctgaagctgctgccgtgaaggagaccccggatgcgagggagcaagagaagcgccaattaaccatcttctacggtgggaaggtcctggtgtttgatgacttcccagctgagaaggccaaggacctgatgcagatggccagcaagagttcctccacagcgcagaactgtgtccttcttccatcttccgctactgcaaccgttgccgacaacactaaggtgtctgctgtaccagccccagcaagtgcacttccggttgctcaggccaatgccccgaaacctgttcgtccaaatgctgctgatctgcctcaggctaggaaggcgtcgcttcaccggttcctcgagaaaagaaaggatcgccttcaggctaaagcaccctaccagggttccccttcagatgcttctccggtcaagaaggagctgcaggagagtcagccatggcttgggttaggacctcaggttgccgctcccgacctgagcttgcggcaggaatcgagccaatgaatcaatgctcaattctgagatgcccctctcatcagatgattcagtcatagaggttatcacaactcttgaattgggtgttttgtgttaggagatgatccgatgacaaggt

SEQ ID NO: 1531 - DNA, 694 bp, Artificial sequence
  Cloned MAB1, codon optimized for expression in Maize and Soy
aacaatggcctccgccaagagcggcgagaggggctcctcctccttcgctatggcttgctccctcctctccagatatgtgaggcaaaacggggctgctgctggcgagcttgggctcgggatcaggggcgaggctgacgccaacaagggcaaggaaactatggaacttttcccacaaaacagcggcttcggctccgaggctgccgctgttaaggaaactccagacgccagagagcaagagaagaggcagctcaccattttctacggcggcaaggtgctcgttttcgacgacttccctgccgagaaggctaaggatctcatgcaaatggcttccaagtcctcctccaccgcccaaaactgcgtgctcctcccatcctccgctaccgctaccgtggctgataacaccaaggtgtccgccgtgccagctcctgcttccgctctcccagtggctcaggctaacgccccaaagccagtgaggccaaacgctgccgatctcccacaagccaggaaggcctccctccacagattccttgagaagaggaaggacaggctccaggccaaggctccataccagggctccccatccgatgcctccccagtgaagaaggaacttcaagagtcccagccttggctcggccttggcccacaggtggccgctccagatctctccctcaggcaagagtcctcccagtgatga

SEQ ID NO: 1532 - DNA, 786 bp, Artificial sequence
  Cloned MAB10
aactcacagttccaaacacacaaaaaacacaagatctaaaaaaaaaagcttttatcatttagaaaaatttggtttcgaatttcttcgaagagtgaaaatggcgtctcatcaagaacagagttacaaagctggtgaaaccagaggcaaggctcaggagaaaactggggaagctatgggaacgatgggggacaaaacacaagcagctaaggacaaaactcaagagacagcccagtcagcccaacaaaaggctcatgaaacagctcagtcagctaaagacaagacgtctcaagctgcacaaacgactcaagagagagctcaagagtccaaagacaagacaggaagctacatgtcggaaactggagaagcaatcaagaacaaggcacacgatgcagctgaatataccaaagagactgcagaagcaggtaaggagaagaccagtgggatcttgggccagaccggtgagcaggtgaaacagatggctatgggagctactgatgcggtgaagcacactttagggcttcgcactgatgaaggaaacaaagaacatgtttcttcagctccaagtactactactacgaccactactcgtgagacacagaggaagtgaagaggataaatatttgtttcgtgttcgtggttttcatgtttgtttgctttgattagtgtttgttgcgttcgtgaggttatgccgatccttgttgttgtttattgggtttgaatgtacttctacgtattatcatgtaatggttttcttttataaattggacactagttatttcgggtgat

SEQ ID NO: 1533 - DNA, 513 bp, Artificial sequence
  Cloned MAB10, codon optimized for expression in Maize
atggccagccaccaggaacagagctacaaggccggcgagaccaggggcaaggcccaagagaaaaccggcgaggccatgggcaccatgggcgacaagacccaggccgccaaagataagactcaagaaacggcccagtccgcccagcagaaggcccacgagaccgcgcagtccgcgaaggataagaccagccaagcggcccagaccacccaagaaagggcgcaagagtcgaaggacaagaccggctcctacatgtccgagactggggaggctatcaagaacaaggcccatgacgccgccgagtacaccaaagagaccgccgaggccggcaaggaaaaaactagcggcatcctcggccagactggcgagcaggtcaagcagatggccatgggcgccaccgacgccgtcaagcacaccctgggcctgaggaccgacgagggcaacaaggaacacgtttccagcgccccgagcaccaccaccactaccaccacccgcgagacccagcgcaagtgatga

SEQ ID NO: 1534 - DNA, 545 bp, Artificial sequence
  Cloned MAB100
gaagagttattatggcgagcttgctagataaagccaaggacttcgtggcggataaactcaccgcgatccctaaaccggagggttcagttacggacgttgacctcaaagacgtgaaccgtgactcagttgagtacttggccaaagtctctgtcaccaatccttacagtcattcgattccgatctgtgagatcagtttcactttccacagcgccggcagggagattggaaaggggaagataccggacccgggttctctgaaagctaaggacatgacggctcttgatattcccgtggtggtgccgtatagtatactgtttaacctggctcgagacgttggtgtggactgggacattgactacgagctccaaatcggtctaaccatcgaccttcctgttgtaggggaatttactatccctatctctagtaagggagaaatcaaacttcctacttttaaagatttcttctgatcgacaaaacctatatataagaccacacatcgttatgatggtgaatggtgatgatcgtaatgtaataagttgggtttg

SEQ ID NO: 1535 - DNA, 1344 bp, Artificial sequence
  CT2 promoter
tgctcccttgctacaccaccctcggaggaggagcagcagacccttaaagggtttcgcagtgatatttgggtccgtcgttttcctactctcactggtcatattaatcgttaaccaaagcccggagccattagcaagtaaccccagtagtgtaacggaggcagggtcgtattcaatggcggcgcagccaagagggatagctgaaggagtttcagccaagtcaaacccatcactttttgacaaagttgggtttaattggacaaacgctatgttttactggcaaagaactgcctaccactttcagcctcaaaagaattggatgaatggtaggttacctaattataatttaagttacttcttttgattttcgtcactaaacctttcattttagtttactatttttaaacttaaatatgatttccttttaataatcgaatttaatttgttgtctttttcttactatgcttgcacgttggttcggcacaacttacgtatcttgcttcagatcctgacggtgagttctcatcacatctaaattcttgttgggacaatactgttagtcaaccatttcatcaatcaatgcgtaaaacacaaaaatatcgaatcagaaatttgtgaccaacccaatctgctagttcttccaaatttgagcatttcaaccttgatttgcaattaaagttagcttctacattgaattgaatcatatcttaccctttttcttctactagatccacttataattttatttttcaatactcatttaattaaagtaaataatttaaataatttgtttcatataaaatatatatattctacatcaataagatactaatatcgaatccaccatttgtggtataataaatgcaattatattacaaaaaagttaataaaatattagtagcatagaattaattaatttaaaaaaatatgatttttttagcagaattaaaaaaaacaaatatcttataaaaaaaataaatattaaaagaaaaaagacatatgataacccttagtttacaatctataagttacaaaaaaatagttacttgaccgtttggtttgtttacctgtcgttctaacgtttaagtcctaactaactagttttgcaaaaccttgcttctgtacatcaccatgtaatagcatgtggtttttttagtaattatattaaactctaatagtttaattaaagtagtatgtgacataatggaacaaaaatacgatggtcgcaggtccgttatatcacaagggatggtaccatcttttctatcaatacaaccctgattcagccatatggggcaacatcacttggggccacgctgtatcaaaggacctcattcacggttctat

SEQ ID NO: 1536 - DNA, 1107 bp, Artificial sequence
  Cloned MAB13
cctcgaaaatggccaccattagagtaccaaacgaagttccttctccagctcaggattctgaaactctcaaacaagctattcgcggatggggaacagatgagaaggcgattatacgagttttagggcaaagagaccagagccagagaaggaagattagagaaagttttagagagatttatggcaaagatcttatcgatgttctatcctccgaactgtctggtgatttcatgaaagctgtggtttcgtggacgtatgatccagcagagagagacgcaaggcttgtgaacaagattttgaacaaggagaagaagaagaaaagcttagagaatttgaaggttatagtagagatctcttgcacgacttccccaaaccatttgattgctgtgaggaaagcttattgttcactctttgactcttctcttgaagaacacattgcttcttctctgccttttcctcttgcaaagttactggtgacattggcaagtacattcagatatgacaaagataggactgatgcagaagtagctactattgaggcggctatgctacgtgaagccatagagaagaaacaattagatcatgaccatgtcctgtacatattaggaacgcgtagtatctatcagctcagagaaacttttgttgcttacaagaagaattatggggtcacaattgataaggatgttgatggatgtccaggagatgctgatctgagaagtctattgaaggtggcaatcttttgtattgatactcctgagaaacactttgcaaaggtggtaagagattcgattgagggttttggaacagatgaggattcgttgacgagggcgattgtgacgcgtgcagagatcgatttgatgaaagtaagaggagagtatttcaacatgtataatacaagcatggacaatgctattactggtgatatttctggagactacaaggacttcattatcaccttacttggatccaaaatctgatcgttctttcgtttctttgtcagttgttatattcttggctttgcttgtgacttgtataatcaatcaatacattgtattccaactccagtttgaattgtttaaaaaataatcaaatttctcttgattcttgcag

SEQ ID NO: 1537 - DNA, 1158 bp, Artificial sequence
  Cloned MAB137, codon optimized for expression in Arabidopsis Maize and Tomato
atggccgctgctgctgctatctgcggcgaggatgagccagctccaagagacccagctgccgctgctgagtgcgctgctgctggcggcggcgttgagaggcttgatcttggcgatggcagagctgctcttgttgctggcggcaagagatctgtttaccttatggagtgcgagccagtttggggctgcgttgctactccaggcaggggcggcgagatggaggatgcttgcgctgctgttccaagattcgctgatgtgccagttaggcttcttgctaggagacaggatcttgatggccttggccttgatgctgatgctctgaggctgccatctcatctgttcgctgtgttcgatggccatggcggctctgaggtttcaaactactgtagggagaggcttcatgtggtgctgtctaaggagcttaggagaccaccaaaggatcttggcgagatgagcgacgttgatatgaaggagcactgggacgatcttttcaccaagtgcttccagactgtggatgatgaggtttccggccttgcttctaggcttgttgatggcgagccaaggcttgagccaatcgctgctgagaacgttggctctactgctgtggctgtggtggtttgctcttctcatgtggtggttgctaactgcggcgattctaggatcgttctgtctaggggcaaggagccagttgctctgtctatcgaccagaagccagataggaaggacgagagagctaggatcgaggccgctggcggcaaggttatccagtggaacggccatagggtttcaggcatcctggctatgtcaagatcaatcggcgatagatacctgaagccttacatcatcccaaagccagaggtgacagttgttccaagggctaaggacgatgattgcctgatccttgcttctgatggcctgtgggatgtggtttctaacgaggaggcttgcaaggttgccagacgtcagatccagcagtggcacaagaacaactctgtgaccacctcttcttcagatggcggcgatggctctactgatccagctgctcaggctgctgctgattaccttgtgaggctggctcttaagaagggcagccaggataacatcactgtgatcgtggtggatcttaagccaaggagaaagagcaagaacaacagctgatga

SEQ ID NO: 1538 - DNA, 649 bp, Artificial sequence
  Cloned MAB14
ccagatggaatcctgcccttcggtgaagaacatccttctgctggattccgaggggaagcgcgtcgccgtcaagtactacacggatgattggcctactctctcggcgaagctggccttcgagaagtcggtgttcgtcaagacccagaaagccactgccggagcagaagctgagattgtaatgtttgatggccacattgtggtgtataagttcatccaagacctccatttttttgttactggaggagaggaggagaatgagcttattttagcatcggtccttcaaggattcactgatgcagttgacattattctcagaaataacgtcgacaaaagaacagcactcgaaaatctggatctcatcctattgtgcctcgatgaaattgttgatggagggattgtcctggaaacagaaggaagtgtgatagctgaaaaggtgtcagcacatggaatagaaggtgctacttcactcgctgagcagactatagttcaagccctaacaacagcaagagagcacttgaccaaatctcttcttatgtgatgtgctctgcttttggagctgaagatggagtagcatcccgttgttacatctctaggactgatacgttcattgcaatagaaacgacggaacagaatatctgaatccatttgc

SEQ ID NO: 1539 - DNA, 537 bp, Artificial sequence
  Cloned MAB14, codon optimized for expression in Maize
atggagagctgcccgagcgtcaagaacatcctgctcctcgacagcgagggcaagagggtggccgtgaagtactacaccgacgactggccgaccctgagcgccaagctcgctttcgagaagagcgttttcgttaagacgcagaaggccaccgctggcgccgaggccgagatcgtgatgttcgacggccacatcgtcgtctacaagttcatccaggatctgcatttcttcgtgactggcggcgaggaagaaaacgagctgatcctggccagcgtgctccagggcttcaccgacgccgtggacatcatcctgcgcaacaacgtggacaagcgcaccgccctcgagaacctggacctgatcctgctgtgcctggacgagatcgtggacggcggcatcgtgctcgagaccgagggcagcgtgatcgccgagaaggtgtccgcccacggcatcgagggcgctaccagcctggccgagcagaccatcgtccaggccctgaccaccgctcgcgagcacctgaccaagagcctgctgatgtgatga

SEQ ID NO: 1540 - DNA, 1048 bp, Artificial sequence
  Cloned MAB15
aacaatggctactgctgctgctgctactgctgcatctacttctcttctcgctccagctgcttcttctactgctcctggtgcttctccaaacgctctcttcttcccatcttctgtgccatctcttagagcttacccaaggcttcttctcgctttcagacgtcctgcagccgcagcagcacaaggtgctgttcttgaggaagaggaagttcaggccgatcaacgtgggcaatatgatgacgacgacgatggatacgagggtggaagaggaccagctttcactgctccaactagaccaagaactggaaaggctgctcttccacttaagagggataggaccaggtctaagcgtttccttgagatccagaagttgagagaatctaagaaggattacgacgttccaactgctatctctctcatgaagcaaatgtcatctgctaagttcgttgagtctgctgaggctcatttcaggatgaaccttgatccaaagtacaacgatcaacagcttagggctactgtgaaccttccaaagggaactggacagagtgttaagatcgctgtgcttactcaaggggaaaagatcgacgaggcaagagcagctggtgctgatatcgttggaggggaggatcttattgagcagatcaaggggggattcatggaatttgataagctcatcgcttctccagatatgatgccaaaggtggcaggacttggaaagattcttggtccaaggggtcttatgccaaacccaaaggctggaacagtgtctcctaacatcacccaggcaattgaagagtttaagaagggaaaggttgagtaccgtgtggataagtctggtatcgtgcatattcctttcggaaaagtggatttcccagaagaggatctcatcgctaatttcatggctgtggttcgttcagtggagcgtaacaagccaagtggagcaaagggaatctactggaaaactgcttacctctgctcttctatggggccaagtatcaagctcaatatcaaggaaatgttggattacgggctcgattcttctgattgatga

SEQ ID NO: 1541 - DNA, 1044 bp, Artificial sequence
  Cloned MAB15, codon optimized for expression in Arabidopsis and Maize
atggccaccgccgctgccgctaccgccgctagcacctccctgctggccccagccgccagcagcaccgccccaggcgccagcccaaacgccctgttcttcccgagcagcgtgccaagcctgagggcctacccgaggctgctgctggctttccgccgcccagctgctgctgccgcccagggcgctgtgctcgaggaagaagaggtccaggccgaccagaggggccagtacgacgacgacgatgacggctacgagggcggcaggggcccagccttcaccgccccaaccaggccaaggaccggcaaggccgccctgccactgaagagggaccgcacccgcagcaagcgcttcctcgagatccagaagctgcgcgagagcaagaaggactacgacgtcccgaccgccatcagcctgatgaagcagatgagcagcgccaagttcgtggagagcgccgaggcccacttccgcatgaacctggacccgaagtacaacgaccagcagctgcgcgccaccgtgaacctgccaaagggcaccggccagagcgtgaagatcgccgtgctgacccagggcgagaagatcgacgaggccagggccgctggcgccgacattgtgggcggcgaggacctgatcgagcagatcaagggcggcttcatggagttcgacaagctgatcgccagcccggacatgatgccgaaggtggccggcctgggcaagatcctgggcccgaggggcctgatgccgaacccaaaggccggcaccgtgtccccgaacatcacccaggccatcgaagagttcaagaagggcaaggtcgagtaccgcgtggacaagagcggcatcgtgcacatcccattcggcaaggtggacttccccgaggaagatctcatcgccaacttcatggccgttgtgcgcagcgtggagcgcaacaagccgagcggcgccaagggcatctactggaaaaccgcctacctgtgctccagcatgggcccgagcatcaagctgaacatcaaagagatgctggactacggcctggacagcagcgactgatga

SEQ ID NO: 1542 - DNA, 604 bp, Artificial sequence
  Cloned MAB17, codon optimized for expression in Arabidopsis and Maize
aacaatgtggaagcgtactggtttcgaagaagaggctgttcagctcatcaacagcgatttcagggatctctctctcgctgctaacaggcttgctcatcacgctatcaagctcggtggtatcggtttcggtgcttctttcttcggtctcttcgctgctattgctgcaatctacctcctcatcctcgatagaactaactggaagaccaacatcctcactgctctcctcatcccttacattttcttctccctcccatctctcatcttcgatgtgttcaggggggagttgggaaagtggatcgctgctgtggcagttgttctcagactcttcctcccaaggcatttcccagactggcttgagcttccaggtgctctcatcctcctcatcgtggttgctccatctcttatcgcttctaccttcagggataacatcgtgggtgttgttgtttgcctcatcatcgcttgctacctcctccaagagcatatcagagcttcagggggtttcaggaacagcttcaccaaggctcatgggatctctaacagcatcggtatcatccttctcctcgtgtacccaatctgggctctcgttgtgatcctcttctgatga

SEQ ID NO: 1543 - DNA, 604 bp, Artificial sequence; identical to SEQ ID NO: 1542
  Cloned MAB17

SEQ ID NO: 1544 - DNA, 600 bp, Artificial sequence
  Cloned MAB17, codon optimized for expression in Maize
atgtggaagcgcaccggcttcgaggaagaagccgtccagctgatcaacagcgacttccgcgacctgagcctggccgccaacaggctggcccaccacgccatcaagctgggcggcatcggcttcggcgccagcttcttcggcctgttcgccgccatcgccgcgatctacctgctgatcctggaccgcaccaactggaaaaccaacatcctgaccgccctgctgatcccgtacatcttcttcagcctgccgagcctgatcttcgacgtgttccgcggcgagctgggcaagtggatcgccgccgtggccgtggtgctgaggctgttcctgccgcgccacttcccagactggctcgagctgccaggcgccctgatcctgctgatcgtggtggccccgagcctcatcgccagcaccttccgcgacaacattgtgggagtggttgtgtgcctgatcatcgcctgctacctgctccaagagcacatcagggccagcggcggcttccgcaacagcttcaccaaggcccacggcatcagcaacagcatcggcatcatcctgctgctggtgtacccgatctgggccctggtggtgatcctgttctgatga

SEQ ID NO: 1545 - DNA, 1825 bp, Artificial sequence
  Cloned MAB18, codon optimized for expression in Arabidopsis and maize
aacaatggctaccaagaactacggggagctttacaacatgcttggatggggagagccatacttcatcgtgaacaccgatggtcatctctgcgttaagactaacggacatgagactaagccagggcaagagatcgatgtggtgtctgttgttgaggctgctaaagaagaaggggttcagttcccaatgatcctcagattcccaggtgttctcaagcacagagtggattctctccatgtggctttcgagaacgctatcaagcacactggttacactgctccataccagggcgtttacccagttaaggtgaaccagaacaaggctatcatcaacgacttcgtgactttcggacacagatactcttacggtctcgaggctggttctaagccagagcttctcatcgctatgtcttacctcactaaggcaaagcctggtgctttccttgtgtgcaacgggtacaaggatgctgagtacgttgctctcgctctttctgctagagctatgggtctcaacgtgatcatcgtgcttgagatggaagaagaacttgatatcgttatcgaccagtctaacaagttgggtgttgagccagttcttggtgttagagcaaagctcctcactaagatccctggtcatttcggttctactgctggaaagcacggtaagttcggacttctcgctgagaagatctacgaggtggcaaagaagctccagggtcttaacaagctccattggctcaagctcctccatttccacatcggttctatgatcccaactaccgatatcgtgtctaacgctgctagagaggcttctggtatctactgcactctcgtgaaccagtacggtgctcagatgactactctcgattgcggtggtggtcttggtgttgattacgatgggaccagatctggttcttctgacatgtctgtggcttacggtcttgaagagtacgcttcttctatcgttcaggctgtgagacttacttgcgagtacaacggtggtgttccacatccagttctctgcactgagtctggaagagctatggtgtcacaccacagcatgatcatcctcgaggctttgtctgctattccagagccaaaggatgatgatactccagagcagctccatggaaagatccagcacctctcttctaacgtgccatctccaagggctcttgtggctactgatctccagaagcacgctaccgatatccaaaagcacggcatcgagatgtacaagctcgctaagaagctctctaagaggatcgctggtgatgctaacaccatctacaattaccacatgaacctctcaatcttctctctcgtgccagatttctggggtatcaagcacctcttcccaatgatgccagcttctaggcttaacgagaagccaactcagatgggtactctcatcgatatcacctgcgattctgatggaaaggtggacaagttcatcggtaacgctgatactctcccactccatactctcgatccagagtctgatggttactacgtggctgttctcctttctggtgcttaccaagaggctctctcttgcaagcacaaccttttcggtggtccatctattgtgagggtggagaacaacactgatggtggtggtggtttccatatcgctactgctgatctcggtccaactactgaagagcttatctctaccgtgggttacgatgtgaaagaagatatcaggggggttatcgagaagtgggctagagagaaggaagtttgggagaaagttggagttttcgttgaggctggtctcacttctatgccatacctcgtggagtacaaggttccaaggactgcttgatga

SEQ ID NO: 1546 - DNA, 877 bp, Artificial sequence
  CaMV derived 35S promoter
aagcttgcatgcctgcaggtccccagattagccttttcaatttcagaaagaatgctaacccacagatggttagagaggcttacgcagcaggtctcatcaagacgatctacccgagcaataatctccaggaaatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggactctagaggatcc

SEQ ID NO: 1547 - DNA, 153 bp, Artificial sequence
  Cloned MAB2
aacaaatgatccttcaggcagttaaagggagatgatgagtggtaacatctcgctaattaatgttgcgagaggggtgtctgccccaaccaagcctgttacgacaacagggcactccaatattttaccatctgatcccgaatctaagttttaata

SEQ ID NO: 1548 - DNA, 1570 bp, Artificial sequence
  Cloned MAB20
aaaaatgaattcagaatcgctagaaaatcttcaccgtccattaatcgaatcatcgaagtcgttcgtcgattatcgtctcgagactgtgttaacagatcgagagttaccgtattttcgccggatttatctagcgatgatgattgagatgaagtttctctttcatctggcggctccggcgatctttgtttacgtcatcaacaacggcatgtcaattcttacacgtatcttcgctggacacgtaggaagcttcgaactcgccgccgcttcacttggaaacagtggtttcaacatgttcacctatggacttctgcttggaatgggaagtgcagtggaaacattatgtggtcaagcacatggagctcatagatacgaaatgcttggagtttacctccaaagatcaacagttgttctaatcctaacatgtctaccaatgtcatttctcttcctcttctcaaatccgatcctcacagcacttggagagccagagcaagtggcaacattggcttcagtattcgtctacggtatgatcccggtgatcttcgcttacgcagtcaatttccctatccagaagtttctccaatcacaaagcatcgtcactccaagtgcctacatatcagctgcaacgcttgtgatccatctcatactttcgtggatcgctgtgtatcgtcttggttacggtcttttggctttgtctttgatacatagcttctcgtggtggatcattgttgtggctcagattgtttatattaaaatgagtccgagatgtcgtcggacttgggaaggttttagttggaaagcttttgaaggtctttgggattttttccgattatcagctgcttctgccgtcatgctttgtcttgaatcttggtactctcagattcttgttttactcgccggacttctcaagaaccctgagcttgctttggattctcttgctatctgcatgtcaatttctgcaatctcattcatggtctccgttggattcaacgcagctgcaagtgtgagagtaagcaacgagctaggagccggaaacccgagagcagccgcgttctccacagtcgtgacaacgggagtatcattcttactatcggttttcgaagccatcgtggtcttatcgtggcgtcacgtcatcagctatgcgtttactgatagtccagcagtggctgaggccgttgcggatttatctccctttttagccatcacaattgtcctcaatggaattcagcctgttttgtccggtgtggctgttggatgtggatggcaagcatttgttgcgtacgtaaacattggatgttactacgttgtggggattccagtgggattcgttcttggcttcacttatgatatgggagctaagggaatatggactgggatgattggtggtactttaatgcaaacaataatcttagtgattgtcactttacgaactgattgggacaaagaggttgagaaagcttcgagcagattggaccagtgggaagagagccgtgagccgcttttgaagcaataaataaattaatgaaatgatttgtttatttttattttttttgggagttttgaggtcagattg

SEQ ID NO: 1549 - DNA, 1566 bp, Artificial sequence
  Cloned MAB25
taatcatggggaggaaatctcagcgtaagaacgcgacaatgtttgatagtgatgatgatacaagtagtgtaagctcttcctccaccatgccatctgagagattgttgaatcctggtatggatgaagttactgttctcaaggatgctttgttagatcaatcccttgatgctctctatgagaaaaggagctcaactagagagcaagctttggccaccattgttgacgcatttaacagcgacttgcagtatgagtttgttgaaaagaagtttgccactttattgcaccagtgtttacactgcaccaagaaagggtctactaaggagacttcattagcaactcatgtcattgggttgctagcgttaactgttggactcggggatcatgcacaagaggttttggaagaatctgtcactcctctgtctcaagcccttaaatctggtcgtgaaatcttgaaaataacttcgatacttgagtgtttagcagtcataaccttcgttggcgggaatgatccagagcaaaccgagaaatctatgcagattatctggcaaatgatccaccccaaactagggtctaatgttgtggcaactaaaccttcacctgctgtaataagtgctgttgtatcttcctgggcttttctgctcacaacagttgatcggtggactctaggtcctaaaatttttcaagagactgtaacttatctctctacattgttggaaaaggatgaccgatctgtacgtatagctgctggtgaagcgcttgcagtaatatatgagttgggaactctagagaagttcgctgccgaagtcaaagggtctgctaatggatcagtgaaagaaggaggtgtctctcaggaagcattgatgcacatgcatggcttgaaagctaaagtcactaaacaagttagagagctctctgtagaggcaggtggtaaaggttctgctaagaaagatctcaacacccaacgaaatttgttcaaagatcttgttgaatttcttgaggatggatatgctcctgaaacctcaacaaaagtcggaggggactatttacagacgtcaacgtggtatcagatgatacagttgaattatttgaagcatttcctagggggtggctttattaagcatatgcaggagaatgaattccttcatgatgtatttagtttcactccaaagaagattggtggaggaaagttgtctaatgacgaaaagaggttgtttaaatcaccaaactcagctcttaacaaagcaagaacgcagttcctggccaagcaaaggatgttagctaagaatatgaacgttgggcattacgcagctacagcaatggaggaagaatgatggctctacaattgatttttgaagaatgatggcacactcatctgctgcttttggaaaatgttgttgttccattagtacactttttcttgtttcatgtttttgatttgataattggttccaatattataaccaactcttagaaatgtcttttcatttataacaattttcgaccgttgagtgtaattcctatgattcaacacttgttgtttctgttaagagtgccattgaccaattg

SEQ ID NO: 1550 - DNA, 1329 bp, Artificial sequence
  Cloned MAB25, codon optimized for expression in Maize
atgggccgcaagagccagcgcaagaacgccaccatgttcgacagcgacgacgacaccagcagcgtgtccagcagcagcaccatgccgagcgagcgcctgctgaacccgggcatggacgaggtgaccgtgctgaaggacgccctgctggaccagagcctggacgccctgtacgagaagcgcagcagcacccgcgagcaggccctggccaccatcgtggacgccttcaacagcgacctccagtacgagttcgtggagaagaagttcgccaccctgctgcaccagtgcctccactgcaccaagaagggcagcaccaaggaaaccagcctggccacccacgtgatcggcctgctggccctgactgtgggcctgggcgaccacgcccaagaggtgctcgaagagagcgtgaccccactgagccaggccctgaagtctggccgcgagatcctgaagatcaccagcatcctcgagtgcctggccgtgatcaccttcgtgggtggcaacgacccagagcagaccgagaagagcatgcagatcatttggcagatgattcacccgaagctgggcagcaacgtggtcgctactaagccaagcccagccgtgatcagcgccgtggtgtccagctgggccttcctgctgaccaccgtggacaggtggaccctgggcccgaagatcttccaagagaccgtcacctacctgagcaccctgctcgagaaggacgaccgctctgtgaggatcgccgctggcgaggccctggccgtcatctacgagctgggcaccctcgagaagttcgccgccgaggtgaagggcagcgccaacggcagcgtgaaggaaggcggcgtttcccaagaggccctgatgcacatgcacggcctgaaggccaaggtgaccaagcaagtgcgcgagctgtctgtggaggctggcggcaagggctccgccaagaaggacctgaacacccagcgcaacctgttcaaggacctggtggagttcctcgaggacggctacgccccagagaccagcaccaaagtgggtggcgactacctccagaccagcacctggtatcagatgatccagctgaactacctgaagcacttcctgggcggcggcttcatcaagcacatgcaagagaacgagttcctccacgacgttttcagctttaccccgaagaagattggcggcggtaagctgtccaacgacgagaagcgcctgttcaagagcccgaacagcgccctgaacaaggcccgcacccagttcctcgccaagcagcgcatgctggccaagaacatgaatgtgggccactacgccgccaccgccatggaggaagaatgatga

SEQ ID NO: 1551 - DNA, 357 bp, Artificial sequence
  Cloned MAB3, codon optimized for expression in Arabidopsis Maize and Tomato
atgagggctggcaggctcgtcatcctggtggctgtggctgtggtcgtcgtcgtggctggcggcggcgctgctgagggcgctggcgagtgcggcagggcttctgctgatagggtggccctgaggctcgctccatgcgtgtctgctgctgatgatccacagagcgctccatcttcatcttgctgctccgctgtccacactatcggccagtctccatcttgcctctgcgctgtcatgctctctaacactgctagggtggccggcatcaagccagaggtggccatcactatccccaagaggtgcaacatggctgataggccagtgggctacaagtgcggcgactacactctcccatgatag

SEQ ID NO: 1552 - DNA, 932 bp, Artificial sequence
  Cloned MAB32
ctccacttgttgttcaattccccccccccctctctctctctctctctctccgtcgcagatctcggcaagggggcaacaaggtaggaggcggcgatgggttcggcgagccgcgcggtgtcgtgcctgtgctgcccgtgcaagtgcctggcgtgcggcctcttcagctgcctctgcagcatcctcatctccctcctcgtcaccctcggcgtcctcgccctcatcttctacctcatcttccgcccccacatgatcgccgccaccgtcgactccgccgccctcacccagttcaccctctccaccaactccgccctcgcctacagcctcaccgtcgacctcaccgtccgcaaccccaacaagcgcgtcggcctctactacgacaacgtcgagtccctcgccctcttcgacggccagcgcttcggctacgcccccctcgactccttctaccagtccaccgaggcatccaccaagctctcccccgccttcaagggccagcagccgctccaaggcgacatcaccgccgccaacttcaggtcgcagcagaccgccggcaagttcgacatcgaggtcaagctcaacgccaagctcagggtcaaggtctgggccttcaaggttcccggacccaaggccaagatcagctgccccatcaccgtcccagcgtccgcccccaacgcccccgcattccagcgcaccgactgcaaagtctggttctgatttcgatggttggttccgcttcgcatttggggattactattagccagcactgcttccagtatggacggatggattcttttgtttctttcgatttgttgatgagggattagctcgccggatgttgctgtacatcgctgtggtttaggtggttacatatcttctagcccttgtagctagcgcttgtcatgcacatattatcgatccatgtcttgttcttctta

SEQ ID NO: 1553 - DNA, 1576 bp, Artificial sequence
  Cloned MAB35
cgtgagaactaagaaacacccaagaaaacaaacaaactttttaaaaaatgtccgtttcaacacatcaccaccacgtggtcctcttccctttcatgtcaaaaggccacatcatccctctcctccaattcggtcgtctcctcctccgtcaccaccgcaaagaaccaaccatcaccgtcaccgttttcaccactcccaagaaccaacctttcatctcagacttcctctcggatacgccggagatcaaagtcatctctctccctttcccggaaaacatcaccggaatccctcccggcgtcgagaacaccgaaaagctcccatccatgtcacttttcgtccccttcacacgcgccacgaagcttctccaacctttcttcgaagaaacactcaagactcttccaaaagtttcgttcatggtctctgatggattcctctggtggacatcggagtctgcagctaagttcaacattccaagatttgtctcctacggcatgaactcttactccgccgctgtctccatctctgttttcaaacacgaactctttaccgaaccggaaagtaaatctgataccgaaccggtcactgtaccagactttccatggatcaaggtcaagaagtgtgatttcgaccatggcactaccgagccggaagaatcaggtgcagccctcgaactatctatggaccaaatcaagtcgaccaccacaagccatgggtttttagtcaatagcttctacgagctcgagtcagcatttgttgattacaacaacaactctggtgataaaccaaagtcgtggtgtgttgggccactgtgtttgacagatcctcctaaacaggggagtgctaaaccggcttggattcattggttggatcagaagcgagaggaagggcgtccggttttgtacgtggcgtttggaacgcaggcagagatatcgaacaagcagcttatggaactagctttcggcttggaagattcaaaggtgaactttctgtgggtcacaagaaaagatgtggaggagattattggagaaggattcaacgatagaataagagagagtgggatgatagtgagagattgggtggaccaatgggagatattgtcacatgaaagtgtcaaaggatttttgagccattgtgggtggaactcagcacaagagagcatatgtgtcggggtcccattgttggcttggccgatgatggccgagcaaccgctcaatgcgaagatggttgtggaggagataaaggtgggagtaagagttgaaacggaagatgggagtgtaaaaggttttgtgacaagagaagaactaagtggaaagattaaagaactgatggaaggagaaacggggaaaaccgcaagaaagaatgtaaaagaatattcgaaaatggcgaaagcggctttggtcgaagggactggttcgtcatggaagaatttagatatgattcttaaggagttatgtaagagtagagattcaaacggtgctagtgagtagagtgattaagaattgaataactgaaccagtctatacgtttactaattaaaacaagtattttcaatatacgtcttgtgtaagtcttggtttag

SEQ ID NO: 1554 - DNA, 1521 bp, Artificial sequence
  Cloned MAB36
acagaaatgggtggtttgaagtttcatgtacttatgtatccatggttcgcaacaggccatatgaccccgttcctttttcttgccaacaaattggctgagaaaggtcatacggtcactttcttgcttcccaagaaatctctgaaacagttggaacatttcaatctgtttccacacaacattgtctttcgctctgtcaccgtccctcatgtggatggtctccccgttggcacagagacagcctctgagatccctgtgacatcaactgatctcttgatgtctgctatggatctcacacgtgatcaagttgaagctgtggtccgagccgttgaaccggacctgatcttctttgactttgctcattggattccagaagtagctagggacttcggccttaagactgtaaagtacgtcgtggtgtctgcatcgactatagctagtatgcttgtcccaggtggtgagttaggtgttcctccaccgggatatccatcatcaaaggtgctgcttcgtaaacaagatgcttacactatgaagaaactggagcctacaaatacaatcgatgtcggaccaaacctcttggaacgagtcactacaagtcttatgaactctgatgtcattgcgataaggacagccagagaaatcgaaggaaacttttgcgactatatagaaaaacattgcaggaaaaaggttctcttgacaggtccggtgttccctgagccagacaagactagagagctagaggaacgatgggttaagtggctaagtgggtatgaaccagactcagtggtgttttgtgcactgggctcacaagtcattttagagaaagatcaattccaagaactctgcttaggaatggagctaacaggttcaccgtttcttgtagcggttaagccccctagaggctcatcaacgattcaagaagcacttcctgaaggattcgaagagcgggttaaaggaagaggccttgtttggggaggatgggttcaacaaccattgatattgtctcatccatcagtcgggtgctttgtgagccattgtgggtttggatcaatgtgggagtctttgctgagtgattgtcagatagtcttagtaccacagttgggtgatcaagtcctgaacacaagattgctgagtgacgaactcaaggtttcggttgaagtggcaagagaggaaacaggatggttctcgaaagagagcttgtgcgatgctgtcaatagtgtgatgaaaagggacagcgagctcgggaacctggtgaggaagaatcacaccaagtggagggagacagtagctagtcctggactaatgactggttatgtcgatgctttcgtagagtcattgcaggatcttgtctctgggaccacccatgactgaaagataggaacactatgacgtttctaagtagaagggggtgattaataaggttgatataaaccaaactatcttgaagtgcttatgtttccaagtgtgttttttcttgtttgtatggttcatttattgtttgatgtttctaagttgcagtgagtg

SEQ ID NO: 1555 - DNA, 1418 bp, Artificial sequence
  Cloned MAB4
cagcgaacacgtctacgatggcggatgaaagcgagcggagcggtatggtaatcgacgacgtcggcggcggactgaatcttccaataattgttgcaggcaagcgtaagcgggagctcacatgggaagagaaggcgttgacagttcttgatattgtcgggtcccaacagcaccccgcatgccaacctgccgagcgtgattgcagcctcatagactcggagaaagattactcatctatggccggctgccaggccggagaacacgctagtatatttggcattgacaagaatggggatgattctgatgaaccgtgtgctaaggatgatgccaagcaaagtgatgtggctcctctgaaggaggaggagaattgggagctggacagtgaaccagagctcacatgggatgagaaggtggttgaagttctaaacatagttcgacgccgagagatcaccgaatataaccccaagcagttttgctcaattcctactcgattttgtgcctacaacatagccttctttgacctggacaaagagtcaaagcttgcacgtggaccacctatcaagtcactagctttccccgactactggtgggagatggactctgtcaatgtgattgcaatcaaggtggccgagtctgatgtgggttaccctatcagggtatttggcactgtgctggccagggatgagtacgatttcaggtgtgtctatttgttcaggcgtgacaggaacaatccacagatcatcacctcgccggaggacacactaactctgacaggacctaatcgagcgctgggtgcaatagacaaaatgtatttcgagttcaatttgaagattagagacggtgatgtcgacaaagatttctgcaaaggtgtgcgagaacacaatgccatctgctatacaaagcagccgatgactttatcgctagagagctgcctgagtagaattgattttgtgtatagtcctgttcaattagctgtggaagcttctgttgcagtcaaaattaagggggttgtatccaagtttttcactggcaaagtgactgcttggactactggagatgatcagaacaaaatcatcctgtatgacagtgaagtggaaggcaggaacagagttcttggagctgatggatcagtcgatctgactcgctgtttcgtagccgtcaatttggatgatgaactggtgctcaatgtctgtgtttctgaaggagctggctcaatctttgagctcgttcttggacacaatgatgaagaatgtgtccttgagcaaggtccctatgaactgcaggtgaatgttgtttggacagctgccttgaagcatcgacagcgcagaaaattgtttgagcgtatcggtgacttccgcgtgttaaggtgatatgtagtatgaagatttatatgggggaagctgttacatctcaagcagttc

SEQ ID NO: 1556 - DNA, 1868 bp, Artificial sequence
  Cloned MAB43
gatcaatgaagattcggaacagccctagttttcatgggggtagtggttacagtgtctttagagctcgtaacttaacattcaagaaagttgtgaagaaagtgatgagagaccagtcaaataatcaattcatgattcagatggagaacatgataagaagaattgtccgagaggagatacagcgtagtcttcaaccttttctctcttcatcatgcgtctcaatggagcgatctcgctcagaaacgccatcgtctcgctcacgattgaagctgtgcttcataaactcgccgccatcatcgatattcacggggtccaagatcgaagctgaggatggttctccgcttgtgatcgagctcgtggacgccaccacaaacactctagttagtacgggaccgttctcgtcttctcgggtcgagctcgtgccgctgaacgctgatttcacggaagaaagctggaccgttgagggatttaatcggaatattctcacgcaacgtgaagggaaacgtccgttgctcactggagacctaacggtgatgcttaaaaacggtgttggagttataaccggagatatagctttctcggataactcgagctggactaggagtcggaagttccggttaggtgctaagttgaccggagatggagccgtggaggcgagaagtgaagcttttggatgtagagaccaacgaggagaatcttataaaaaacatcatcctccgtgccccagtgatgaggtttggagactagagaaaatcgcgaaagatggagtttcggcaacgcgtttggctgaacgcaagattttaaccgtcaaggattttcgccgtttgtatactgtaaatcgaaatgagttacacaacataattggtgcaggggtctcaaagaaaacatggaacacaattgtatcacatgccatggattgcgttttggacgaaacagagtgttacatttacaatgcaaacactccgggcgtaacacttctcttcaactctgtttatgagttgataagagtgtcattcaatggcaacgatatccaaaaccttgatcagccaattctagaccaattaaaggccgaagcttatcaaaaccttaaccgcattacagcggttaacgataggacctttgtgggtcatccacaaaggtccttacagtgcccgcaagatcctggatttgtcgtaacatgttctggatcgcagcacatcgactttcaaggaagtttggatccatcaagctcttcgatggctctttgccacaaagcttcaagctcaacggtccaccctgatgtcctgatgagttttgataactcatcaaccgcgaggtttcatatcgacaaaaagttcttaccgactttcggaaacagcttcaaagtaagtgaactcgatcaagtacacggaaaatcacaaactgttgtgacaaaaggttgtatagagaataacgaggaggatgagaacgcgttttcttatcatcaccatgatgacatgacctcaagctggtcacctggtacgcaccaagccgttgaaacgatgtttcttaccgtgtctgagacggaagaagctggaatgttcgatgttcattttgcaaacgttaatttgggatctccaagagccaggtggtgtaaggttaaggcagctttcaaggttagggcagcttttaaggaagtccggagacacacaactgccagaaatccgagggaaggcttgtaagaactcttgcctacctattaaaatcagcggtttcttgcgttgcacgataaatgtgtatatatatttgtgaatagggttagataaatggatcccggccattgagttacggggattagcctttgcgtatatcaaagtatttttttccctgggtaagtatagctgtggcacagg

SEQ ID NO: 1557 - DNA, 950 bp, Artificial sequence
  Cloned MAB44
ccataaagaacagtgacaggcgaaatttctcaagaaagcaaatcggaagaactcacaaaaaaaactaagatggagacagagaagaaaaatagcaaggaggtagcgctaaaacacctagcgttcgtgagaattgcaacgatccatattctggcttccgtctcaaatctctacgaatacgctaaacaaaactccggtcctctcaaatccgccgtggaaaaggtcgaaggagccgtcaccaccgtcgtcacccctgtctatcagaaattcaaagatgttcctgattctctcctggtctttctagatcacaaggtgggtgaagtttcgtacaagtttgatgagcatgctcctccaatggctaagaaagtggtgaatcaagcacatgtattgatctacaaggcgacagagaaagctcaaagctttgtgaaagaggctcgtaccggtggtcccaaagctgcgtttaactatgctgcaactgagtacaagtttttcgttgtgaccaactcggttaaagtctgggctaaacttaaccagtataaaccaatccatgcaatgggtgacaaagctttgcctgtggctgcacacttttccagtcggtacaacgatttggtgactgatatgactaatatgggttactctttggttggttatcttccgttggttcctgttgatgacattgttaaggcttatgaaaaggaagatgcaaggagaaagaaaggaggggatacggctggaaagaaaggagagactactgatgcggctgatggtgataaatcatcgtctgattcggagtaggattgagacattttgtgatttgttgctgctttggaaagtttggtttgttgggttttggttatgtgtgtaaatgatcttaggacctctctttttttcttctatcacagaactttgaactagtgttttatctcttggtgctgtgaaaatgtactacgtgg

SEQ ID NO: 1558 - DNA, 726 bp, Artificial sequence
  Cloned MAB44, codon optimized for expression in Maize
atggagaccgagaagaagaacagcaaggaagtcgccctgaagcacctggcctttgtgcgcatcgccaccatccacatcctggccagcgtgtccaacctgtacgagtacgccaagcagaacagcggcccactgaagagcgccgtggagaaggtggagggcgccgtgaccaccgtggtgaccccggtgtaccagaagttcaaggacgtcccggacagcctgctggtgttcctggaccacaaagtgggtgaagtgtcctacaagttcgacgagcacgccccaccgatggccaagaaggtggtcaaccaggcccacgtgctgatctacaaggccaccgagaaggcccagagcttcgtgaaggaagcccgcactggcggcccaaaggccgccttcaactacgccgccaccgagtacaagttcttcgtggtgaccaacagcgtgaaagtgtgggccaagctgaaccagtacaagccgatccacgccatgggcgacaaggccctgccagtggccgcccacttcagcagccgctacaacgacctggtgaccgacatgaccaacatgggctactcccttgtgggctacctgccgctggtgccggtggacgacatcgtgaaggcctacgagaaggaagatgccaggcgcaaaaagggtggcgacaccgccggcaagaagggcgagaccaccgacgccgccgacggcgacaagagcagcagcgacagcgagtgatga

SEQ ID NO: 1559 - DNA, 1902 bp, Artificial sequence
  Cloned MAB46
ccttgtctgttccagatgaaattgtgagttctccgagttatatgcatccgttagaatcaaagcggtaatcaaaagcagaatttagaggattgaaaaagatggttttggggtgtttccctttgaaaagcaagaagaaacgtggctctgtttctatgaagcggttggatcttgaagaaagcaagccaactgctttacctgagccaccaaagattccaagtcgtaatttacaatcagctcctccgagtttcagaactcgtgtgaagccaattcaatctaacaacggtggaaccggagagatgagtagccgagcaagagtcatgtctgctccgtcaagcatccacggtgcagcggaacgggatttgcttgctggtgtttaccacgacgagcaagatgaacaaccaagagatccacgtacttctactaaagaatctagccctcaaccacttccgttaccgtcaccaagaactggttcttcattgaagaattggggaagctttaagtcgtttaacggaagcagcggtcggttatcatcatccgcagctgtatctggacctttacctttgccacctagcgggtcagttaggagcttttcatatgatgaagtaatggctgcgtgtaacgctttttcttcagaccgatgtgtcatggaaggtctttcatctgttatgtacatggcttcctttggtgatgaggcttcgacctcaggtttaaagaaggttgacgcaactgttgtacgacttcacgtaattactcagagtattagggagttcattaatgaagtcaacacattggcgtcgctgcaacaccagaacctttgtaagctggtaggctatcatgctcgtgacggttctgacacaagaatgttggtgtacgagaggcttgctctgggcagcttggaccgtttactgcatgggagatcagatgggcctcctcttgattggaacactagaatgaagattgcactatgcgcagctcagggtctaaccttcttgcacgaagaaggcccttttcaggcaatgtacaatgaattttcgacggcaaatatccaagtcgataaagatttcagcgccaagctatcaggatacggttgtgcaggccatgcgcctgagacagagacatctaatagttcggcacttgctaatctctctgtcgagactctagagagagggcttttgaccccgaagagcaatgtgtggagctatggaatagttcttcttgagatgttaacgggtcggaaaaatatggacgggtcttacccgaaagaagagaggaacttagtgaaatggagcagagcttttctagcagatgattgcaggctctcgcttataatggatcctcagcttaaaggtcggtttccggcaaaagcggctaggagcatagcagatatagcacagaaatgtctgcaggtggagccttcagagcgtccaaccatgagaaacatcgtggatcaactcaagatcatacaggacatgaagtactcgtgtaggttcccattgagagaacccgcaccggtcgtggcaaggaaacatatgggaagatcaagcagtctcaacacgattatttggaccccggcatcagtgccaccaaggtcgagtttttcaccgtcacctccaccacgacgaccgtctgtctcacccacaaggggacggacgctcgtgtttcccccagtgtttccgccgcgagcgtgttcatctttggaggaaatggctcgggaagaggttcgaagatcgtcttcagccagtggtaggagaactagcctcgaagggttttgatttgttcatatctctcttctttcttctttttcctatttgtttttaatttttggcgttgatttgttttttggattccaaatataaaaaattgtttttttctttttcttttgttgtttatgaatccggacgg

SEQ ID NO: 1560 - DNA, 2012 bp, Artificial sequence
  Cloned MAB50
tttaggctcaaggattcaaatgaaaatcagaagtctctagaaaaaccccaaaacactctttcttcactccccctataaattctcatcacaatttctcaaaccatctcatctctgccaacacactctctagaattctctcgtgattatcgatttcactctcttaaatttgatcagaaaatggaagacgatttcgacacgcagaaccagtttccggaagaggagccagaggagatggatatggatctccccgacaatgacgaagctgactctgctccttatctgaaaatcggcgaggaaatggagatcggaaaatcaggattgaagaagaaacttgttaaggaatgtgaaaaatgggacacgcctgagaacggtgacgaagttgaagtgcattacactggaactttgttagatggtaccaagtttgattcgagccgtgacagaggaactcctttcaaatttactcttggccaaggacatgtcattaaaggatgggacttggggatcaagacaatgaagaaaggtgaaaatgctattttcaccattcctcctgagctggcatatggtgaaaccggttcaccgccgactatacctccgaacgctactcttcagtttgatgtggagttgatagcatggaggagtgttaaggatatatgtggtgatggtggtgtgtctaagaaaataattgtggaaggagaaaaatgggagaagccaaaagaccttgatgaagtttacgtcaagtatgaagctcggcttgaggatggcaccattgttggaaagtctgatggtgtagagtttactgtcaaggagggccatttctgtcctgcgctttctaaggctgtcaaaaccatgaaaagaggggagaaggttctcctgactgtgaagccacaatatggatttggggaatttggaagaccagcttctgatggtcttcaagctgcaatcccaccaaatgcaacccttcagattgaccttgagttggtttcttggaagactgtggtggaagtaactgatgacaggaaggttattaagaaaatactcaaggaaggagaaggatatgagcgtcccaatgaaggagcgattgtcaaattgaagttgattggtaaacttcaagatggaacaaccgtgtttgtgaagaaaggtcatgaagaagatgaggagccgttcgagttcaagattgatgaagaacaagtgatagaagggcttgaaaaagctgtgatgggcatgaagaagggtgaggtagcactcatcacaatttcaccggaatatgcttttggttcctctgaatcaaaacaggagctggctgtaataccgccaaactcgactgtatactatgaggtcgagttggtatctttcatcaaggagaaagagtcttgggatatgaacacacaggaaaggatagaagctgcaggcaagaagaaagaagaaggcaatgtgttgttcaaagctggaaaatacgcaagagcttcaaagagatacgagaggggtgtcaaatatatagaatatgactcaactttcgacgaagaggagaaaaagaaatcaaaagatctcaagattgcctgtaacctgaatgatgcagcttgcaagctgaaactgaaagattacaaggaagcagcaaaattgtccacaaaggtgttggagatggatagtaggaacgtgaaggcaatgtataggagagcacatgcctacttggagacggcggatcttgatctggctgagcttgatatcaagaaagctctcgaaatcgatccagacaacaaggaggtgaagatagaatataagaagttgaaggagaaggtgaaagagtataacaagaaagatgctaagttttacagcaacatgttgtcgaaaatgcttgagccacacaaaggaactcagaaggaagcacaagcgatgagtattgacaccaaggcatgagtctttgaatcactttagagagtcgcattgattccaaaaactaaatgtgaaaagtctacaaatttctgtttttactctttgtaatcaatcttggtgtg

SEQ ID NO: 1561 - DNA, 1479 bp, Artificial sequence
  Cloned MAB6
ttcgtaagctcaaagatttcgatttcgattttgattattgccaaaggtttaaagatggatattttcgacaactctgatcttgaataccttgttgatgaatttcacgctgatttcgatgatgatgagccctttggagaggttgatgtcaccagtgagtctgattccgatttcatggactccgattttgatttcgagctgagtgagagtaagacgaacaatgaaacatcagcgttagaagctaggaatggaaaagatattcaagggattccatgggagagcttgaattacacgagggatagataccgtgagaatagattgctgcactataaaaactttgagagtctgtttcgatccagagaagagcttgataaggaatgcttgcaagtagagaaaggaaagaacttttatgactttcagttcaatacaaggcttgtcaagtccacaatagcgcattttcagctgaggaacttggtatgggcaacatcaaagcacgatgtgtatttcatgaacaactactctctcatgcactggtcatctttgttgcaaaggggcaaagaagtacttaatgtggcaaagcccattgttccttcaatgaagcagcatggatcgttgtcacagtctgtatcaagagtccagataagcaccatggcagttaaagacgatttgatagttgcgggagggttccaaggagagcttatctgtaagaaaatcaacgaacctgaggttgctttctgcactaaactaacatcagctgataacgacatcaccaattcggttgacatctacaacgcacctagtggctcgttaagggttatgaccgcgaacaatgactgtactgtccggctatttgatgccacaaactttgccttgctcaacagatttgcctttcactggtctgtaaataacatctccaccagtccagatggtaagctagtggctgttctaggagacagtcctgagtgcttactagcagataccggatctggaaaagtgatccacggactcgaaggccatctcgactactcgttttcatcagcatggcacccaaacggtcaaatcttagccacgggtaaccaagacacaacctgtagactatgggacgtaaggaacctgtctcaatcactcaaagtcttgaaaggaaacatgggagctatcagagccttgaggttcacgtctgatggacggttcttagccatggctgagccagcggactttgtacacttgtttgacacggaagctggttacagtcagtgtcaagagattgatctgtttggagaaatagcgggaatctcgtttagccccgacacggaggcactgttcgtgggagtagctgatcgtacgtacggcagcttgttggagtttaacaggaagcgaaaccactcgtatgttgattccatattctgatctgactccaatcgttagaagcaaattaaggagctatatgtatgtgtgagattatggttgtagtggctgttggag

SEQ ID NO: 1562 - DNA, 1353 bp, Artificial sequence
  Cloned MAB6, codon optimized for expression in Maize
atggacatcttcgataacagcgacctcgagtacctggtggacgagttccacgccgacttcgacgacgacgagcccttcggcgaggtggacgtgaccagcgagagcgacagcgacttcatggactcggacttcgacttcgagctttccgagagcaagaccaacaacgagaccagcgccctcgaggccaggaacggcaaggacatccagggcatcccatgggagtccctgaactacacccgcgaccgctaccgcgagaaccgcctgctgcactacaagaacttcgagtccctgttccgcagccgcgaggaactggacaaggaatgcctccaggtcgagaagggcaagaacttctacgatttccagttcaacacccgcctggtgaagagcaccatcgcccacttccagctgcgcaaccttgtgtgggccacctccaagcacgacgtctacttcatgaacaactactccctgatgcattggtctagcctgcttcagcgcggcaaggaagtgctgaacgtcgccaagccgatcgtgccgagcatgaagcagcacggcagcctgagccagagcgtgtcccgcgtccagatctccaccatggccgtgaaggacgacctgatcgtggctggcggcttccagggcgagctgatctgcaagaagatcaacgagcccgaggtggccttctgcaccaagctgaccagcgccgacaacgacatcacgaacagcgtggatatctacaacgccccgagcggcagcctcagggtgatgacggccaacaacgactgcacagtgcgcctgttcgacgccaccaacttcgccctgctgaaccgcttcgccttccactggtccgtgaacaacatcagcaccagcccggacggcaagctcgtggccgtgctgggcgacagcccagagtgcctgctggccgacaccggcagcggcaaggtgatccacggccttgagggccacctggattactcgttcagcagcgcctggcacccgaacggccagatcctggccaccggcaaccaggacaccacctgccgcctgtgggatgtgcgcaacctgagccagtccctgaaggtgctgaagggcaacatgggcgccatccgcgccctcaggttcaccagcgacggccgcttcctcgccatggccgagcctgccgacttcgtgcatctgttcgacaccgaggccggctactcccagtgccaagagatcgacctgttcggcgagatcgccggcatcagcttcagcccggataccgaggcgctcttcgtcggtgtcgccgacaggacctacggcagcctgctcgagttcaaccgcaagcgcaaccacagctacgtggacagcatcttctgatga

SEQ ID NO: 1563 - DNA, 2049 bp, Artificial sequence
  Cloned MAB7
tcttctttggttcttacatttctctatatcattttttgtccttccattaaaaacggaataaacagaatgaacggtggtgatgtcaccgtcgccggatccgacgatctgaaatctccgctcttaccggtcgtccataatgatgaaccattcgaacgacaaacggtgggacaacaacttcggacaatattcacgcccaaaaactgttacatcgctcttggtcctcttctttgcgccgtcgtgtgtctatgcgtagatctcgggggagatgaaacgacgacggcgaggaacatgctcggtgttttggtgtggatgttcgcgtggtggttgacggaggccgttccgatgccgatcacctccatgacgccgctcttcctcttccctctctttggtatatcggctgcggatgacgtagcaaattcttacatggatgacgtcatctcccttgtactcggcagcttcatacttgctctcgccgtcgaacactacaacatccatcgccggcttgcccttaacataacgttggtgttctgcgtggagccgctaaacgcgccgctacttctgcttggcatctgcgccacaacagcgttcgtaagcatgtggatgcataacgtagcagctgcagtcatgatgatgcctgtcgctacggggatacttcagagactgccctcgtcatcatcgacgacggaagtggtgcatccggccgtggggaagtttagcagggcggtggtgttaggtgtgatatactctgcggcggttggtgggatgagcacactcactggaacaggagtgaatctgattcttgttggaatgtggaaaagctacttccctgaggctgatccgatcagttttagccaatggttcttctttggcttcccattggctttgtgcatattcgtggtgctttggtgtgttctttgtgttatgtattgtcctaaaggagcaggacaagctctctctccttatctccataaatctcatctcaggagagagcttgatttgttagggccaatgaacttcgctgagaagatggtcttagccgtgtttggtgggttggttgtgttgtggatgacaaggaatataactgatgatatccccggctggggtcggatcttcgccggccgagccggggatggaaccgtgagtgtgatgatggcgacattgttgtttatcatcccaagcaatattaaaaaaggagagaagctaatggactggaacaaatgcaagaaactaccatggaacattgtcttgttattgggagctggattcgctatagccgatggagtacgcaccagtggcttagctgaggtcttatccaaaggacttgtcttccttgaaacggctccttactgggccattgctccaacggtttgcctcatcgctgctaccatcacagagttcacttcaaacaacgcaaccactacattgttggttccgttactcatcgaaatcgcaaagaacatggggatccatcctttgctcttgatggttccaggagccattggggctcagttcgctttcttgcttcccacgggaacaccctctaacgtcgttgggttcacgacagggcatatagagatcaaagacatgatcaagacaggcttgcctctcaagatcgctggaaccatctttctctccatcttgatgcccactcttggggcttacgtttttgcatcaatgggaggagtttagttctacaagccaagcacaagaccatttacacaattgatttattgtactatattgtttactaccgtaatacatatgtagatatatagtcaatggaatgggaaatttagatgaggtcaaaattcacaaaatcggcccatttttgtaacccgcccgattatagtttccggtaccattgctttcttttgtgcttccaacgtaccggtaactttggtcccttttttttttttgtttggtgtgtatatgaaaaagggttaatacagatttgtgtgttcttcttcctaacaatagcaactagtggcaaatccagcgcgcggtccaacctggccataccataccacgtcattgtccagcgtgtcttct

SEQ ID NO: 1564 - DNA, 1292 bp, Artificial sequence
  Cloned MAB9
ggttgctgaggaatcgaagtagaagagtataaatgggtgttagagagaaagatccgttagcccagttgagtttgccaccaggttttagattttatccgacagatgaagagcttcttgttcagtatctatgtcggaaagttgcaggctatcatttctctctccaggtcatcggagacatcgatctctacaagttcgatccttgggatttgccaagtaaggctttgtttggagagaaggaatggtatttctttagcccaagagatcggaaatatccgaacgggtcaagacccaatagagtagccgggtcgggttattggaaagcaacgggtactgacaaaattatcacggcggatggtcgtcgtgtcgggattaaaaaagctctggtcttttacgccggaaaagctcccaaaggcactaaaaccaactggattatgcacgagtatcgcttaatagaacattctcgtagccatggaagctccaagttggatgattgggtgttgtgtcgaatttacaagaaaacatctggatctcagagacaagctgttactcctgttcaagcttgtcgtgaagagcatagcacgaatgggtcgtcatcgtcttcttcatcacagcttgacgacgttcttgattcgttcccggagataaaagaccagtcttttaatcttcctcggatgaattcgctcaggacgattcttaacgggaactttgattgggctagcttggcaggtcttaatccaattccagagctagctccgaccaatggattaccgagttacggtggttacgatgcgtttcgagcggcggaaggtgaggcggagagtgggcatgtgaatcggcagcagaactcgagcgggttgactcagagtttcgggtacagctcgagtgggtttggtgtttcgggtcaaacattcgagtttaggcaatgagagagatgtgaagttactgatgggtgaaaaaagtaaaaaaaaaacttggagatagtagagtggcaattgatgtaaataatagggatttatatggggcttttaccgattcggtgaggcttaggattccacaaaggaaaaaggctcgactggggactagtttgatccaacttgacggcccacaaatgtgtaatgtttctcaacggagagaaaaataaatggttaccaatatttttacaccggttatgtgttgataccatttgcacaaaacggtttaagttctgaattgaataacttaacacccaaaatttggtaaaaagcttaatacaaaaagttcaaaggcattttcgcttactgcgacactcggag

SEQ ID NO: 1565 - DNA, 897 bp, Artificial sequence
  Cloned MAB9, codon optimized for expression in Maize and Soy
atgggagtgagagagaaggacccactcgcccagctttcacttccaccaggcttcaggttctacccaaccgacgaggaactgctcgttcagtacctctgcaggaaggtggccggctaccacttctccctccaggtgatcggcgacatcgacctctacaagttcgacccatgggacctcccatccaaggccctcttcggcgagaaggaatggtacttcttctccccaagggacaggaagtacccaaacggctccaggccaaacagggtggccggctccggctactggaaggctaccggcaccgacaagatcatcaccgccgacggcagaagagtgggcatcaagaaggccctcgttttctacgccggcaaggccccaaagggcaccaagaccaactggatcatgcacgagtacaggctcatcgagcactccaggtcccacggctcctccaagctcgacgactgggtgctctgcaggatctacaagaaaacctccggctcccagaggcaggctgtgaccccagttcaggcctgcagagaagagcattccaccaacggctcttcctcatccagctccagccagctcgacgacgtgctcgactccttcccagagatcaaggaccagtccttcaacctcccaaggatgaactccctcaggaccatcctcaacggcaacttcgactgggcttccctcgctggcctcaacccaatcccagagctggcccctaccaacggcctcccatcctacggcggctacgacgctttcagggctgctgagggcgaggctgagtccggccacgtgaacaggcagcagaactcctccggcctcacccagtccttcggctactcctccagcggcttcggcgtgtccggccagaccttcgagttcaggcagtgatga

SEQ ID NO: 1566 - DNA, 1807 bp, Artificial sequence
  Cloned MAB99
cagttaattctccgttgtctactccggcgatagtttaccggcggcgagtgaaagttgtctctctcactatatctactgactaatcatggctaggaagatgctaattgatggagagttgagcaaacctggtgaagaagaagcgcactatgactttgatttattcgtaataggtgctggaagtggtggggttcgagctagtcggttttcagcccaatatggagctaaggttgcaatctgtgagcttccgtttgatcccatcggctctgaagttagtgggggagttggtggaacgtgtgttcttcgtggttgcgttcctaaaaagattttggtttatggagcagcctatgggccagaactggaggatgcaaagaattatggatgggaagtgaatgagaatgtcaatttcaactggaagaagcttttgcataaaaagaccgaggagattgtacggttaaatgggatctataagaggctactttcaaatgcaggagtaaaactatttgaaggtgagggaagagtggtaggtccaaatgaagttgagttaattcaactggatggcaccaagataagctattcggcgaagcacattctaattgcaactggtagtagggctcatcgtccagacattccaggacaggagctagccataacttcagatgaagccttgagcttggaagagttaccaaagcgtgctgtgatacttggtggagggtacattgctgttgagtttgcttctatatggcgaggaatgggttcaacggtggatctatgtttcagaaaggaactcccattgagaggttttgatgatgaaatgcgagctgtagttgcaagaaatctagaaggcagaggaatcactatgcatccttgcacgacattgactaagcttgaaaaagcagaaggtggcatcaaagtgcacacagaccatggtgaagtgatattggcagatgttgtgctcgttgcaactggtcgtctccctaacacaaaaaggttgaatctggatgctgttggtgtcgagcttgacaacatgaaagcggtgaaggtagatgagtactcacgcaccaatatacccagcatttgggctattggtgatgtcaccaatcgaatgaatctcactcctgttgctttgatggaaggaacctgttttgcgaaaactgttttcggtggaaagcctaccaagcctgactactcacatatcccatgtgctgtgttctgcatcccgcctctctctgttgtggggttcagcgaagaacaggccatagagcaaataaatggagaagtttcagtttacacatcatcattcaatccaatgaagaacaccatatctggacgaacagagaagtcagtaatgaagcttcttgttgatgcccagacagataaagttataggggcatccatgtgcggtccagatgcacctgaaatcatgcagggcattgccgttgcactaaagtgtggagcaaccaaggagcagtttgacagtacagtgggaatacatccttctgccgcagaagagtttgtgaccatgcgttcagagtcgaggcgcatttcttcaaacaaaccaaagacaaacctctgaggaaccaaagatgtgataaaaccatattgccacataaaaaaaagggtgatttcatgagggaaaaaaaagaacacctacattcagtatttacttcatagtattagctacatggtgcgattttgtttttgtgattttgaatacgtttgtgaggaccaacagagaaatatctgcatgttgaataaacagtagcgcttgggtcttttgataattgtactagcagcaagtttcaagcag

SEQ ID NO: 1567 - DNA, 31 bp, Artificial sequence
  Single strand DNA oligonucleotide
aagatatcagaccagaggagaagactcgatc

SEQ ID NO: 1568 - DNA, 29 bp, Artificial sequence
  Single strand DNA oligonucleotide
aagatatcagactccgttcggagaaaagg

SEQ ID NO: 1569 - DNA, 30 bp, Artificial sequence
  Single strand DNA oligonucleotide
atgatatctgaagaacatcgccttgtcatc

SEQ ID NO: 1570 - DNA, 30 bp, Artificial sequence
  Single strand DNA oligonucleotide
aagatatcaccttgtcatcggatcatctcc

SEQ ID NO: 1571 - DNA, 31 bp, Artificial sequence
  Single strand DNA oligonucleotide
atgatatccaacgaatgaagactagtagctg

SEQ ID NO: 1572 - DNA, 27 bp, Artificial sequence
  Single strand DNA oligonucleotide
atgatatcccagatggaatcctgccct

SEQ ID NO: 1573 - DNA, 29 bp, Artificial sequence
  Single strand DNA oligonucleotide
atgatatcgtgtcaatgaagggaacgtgc

SEQ ID NO: 1574 - DNA, 30 bp, Artificial sequence
  Single strand DNA oligonucleotide
atgatatcgcaaatggattcagatattctg

SEQ ID NO: 1575 - DNA, 31 bp, Artificial sequence
  Single strand DNA oligonucleotide
gcagtcgacaactcacagttccaaacacaca

SEQ ID NO: 1576 - DNA, 31 bp, Artificial sequence
  Single strand DNA oligonucleotide
ggtctagaatgtaaatgtcttcgtattaggc

SEQ ID NO: 1577 - DNA, 30 bp, Artificial sequence
  Single strand DNA oligonucleotide
cctctagaatcacccgaaataactagtgtc

SEQ ID NO: 1578 - DNA, 30 bp, Artificial sequence
  Single strand DNA oligonucleotide
aactgcagccatcgtcgtaatccttctagc

SEQ ID NO: 1579 - DNA, 29 bp, Artificial sequence
  Single strand DNA oligonucleotide
aactgcagtaatcatggggaggaaatctc

SEQ ID NO: 1580 - DNA, 23 bp, Artificial sequence
  Single strand DNA oligonucleotide
gggtgacaattccgagtctcagc

SEQ ID NO: 1581 - DNA, 26 bp, Artificial sequence
  Single strand DNA oligonucleotide
tcccgggcaattggtcaatggcactc

SEQ ID NO: 1582 - DNA, 28 bp, Artificial sequence
  Single strand DNA oligonucleotide
aatgtcgactctcgtcttgctcccagag

SEQ ID NO: 1583 - DNA, 28 bp, Artificial sequence
  Single strand DNA oligonucleotide
aatgtcgaccgacacccttctcctcctc

SEQ ID NO: 1584 - DNA, 30 bp, Artificial sequence
  Single strand DNA oligonucleotide
tttctagaatcatattccaacatccacttc

SEQ ID NO: 1585 - DNA, 31 bp, Artificial sequence
  Single strand DNA oligonucleotide
tttctagactgctatgttccactgactacac

SEQ ID NO: 1586 - DNA, 33 bp, Artificial sequence
  Single strand DNA oligonucleotide
aaagtcgaccagttaattctccgttgtctactc

SEQ ID NO: 1587 - DNA, 28 bp, Artificial sequence
  Single strand DNA oligonucleotide
tgagctcctgcttgaaacttgctgctag

SEQ ID NO: 1588 - DNA, 30 bp, Artificial sequence
  Single strand DNA oligonucleotide
ggagtcgacacagaaatgggtggtttgaag

SEQ ID NO: 1589 - DNA, 31 bp, Artificial sequence
  Single strand DNA oligonucleotide
cctctagaaatgatcactcactgcaacttag

SEQ ID NO: 1590 - DNA, 32 bp, Artificial sequence
  Single strand DNA oligonucleotide
cctctagacactcactgcaacttagaaacatc

SEQ ID NO: 1591 - DNA, 31 bp, Artificial sequence
  Single strand DNA oligonucleotide
aacgtcgacgctcatttctcttcttctttgg

SEQ ID NO: 1592 - DNA, 33 bp, Artificial sequence
  Single strand DNA oligonucleotide
gacgtcgactcttctttggttcttacatttctc

SEQ ID NO: 1593 - DNA, 29 bp, Artificial sequence
  Single strand DNA oligonucleotide
tctctagagcaagacgttataaaccatgc

SEQ ID NO: 1594 - DNA, 28 bp, Artificial sequence
  Single strand DNA oligonucleotide
tctctagaagaagacacgctggacaatg

SEQ ID NO: 1595 - DNA, 30 bp, Artificial sequence
  Single strand DNA oligonucleotide
aaggtcgaccataaagaacagtgacaggcg

SEQ ID NO: 1596 - DNA, 30 bp, Artificial sequence
  Single strand DNA oligonucleotide
agagctccacgtagtacattttcacagcac

SEQ ID NO: 1597 - DNA, 29 bp, Artificial sequence
  Single strand DNA oligonucleotide
accgtcgacccttctccaatttcgtaagc

SEQ ID NO: 1598 - DNA, 30 bp, Artificial sequence
  Single strand DNA oligonucleotide
accgtcgacttcgtaagctcaaagatttcg

SEQ ID NO: 1599 - DNA, 29 bp, Artificial sequence
  Single strand DNA oligonucleotide
cctctagaacgacttttaatccctccaac

SEQ ID NO: 1600 - DNA, 28 bp, Artificial sequence
  Single strand DNA oligonucleotide
cctctagactccaacagccactacaacc

SEQ ID NO: 1601 - DNA, 30 bp, Artificial sequence
  Single strand DNA oligonucleotide
aagatatcggttgctgaggaatcgaagtag

SEQ ID NO: 1602 - DNA, 31 bp, Artificial sequence
  Single strand DNA oligonucleotide
ttgatatcgagccaagtcacaaggagtttac

SEQ ID NO: 1603 - DNA, 28 bp, Artificial sequence
  Single strand DNA oligonucleotide
ttgatatcctccgagtgtcgcagtaagc

SEQ ID NO: 1604 - DNA, 34 bp, Artificial sequence
  Single strand DNA oligonucleotide
aatgtcgacccaagttaaacttcatatcatacac

SEQ ID NO: 1605 - DNA, 30 bp, Artificial sequence
  Single strand DNA oligonucleotide
aatgtcgacgaagagttattatggcgagct

SEQ ID NO: 1606 - DNA, 34 bp, Artificial sequence; identical to SEQ ID NO: 1604
  Single strand DNA oligonucleotide

SEQ ID NO: 1607 - DNA, 31 bp, Artificial sequence
  Single strand DNA oligonucleotide
aatctagacaaacccaacttattacattacg

SEQ ID NO: 1608 - DNA, 30 bp, Artificial sequence
  Single strand DNA oligonucleotide
aatgtcgacctcgaaaatggccaccattag

SEQ ID NO: 1609 - DNA, 28 bp, Artificial sequence
  Single strand DNA oligonucleotide
cgagctccaaaaatgcaagaatcaagag

SEQ ID NO: 1610 - DNA, 28 bp, Artificial sequence
  Single strand DNA oligonucleotide
aaggtcgacttctctccaaaatggccac

SEQ ID NO: 1611 - DNA, 29 bp, Artificial sequence
  Single strand DNA oligonucleotide
tgagctctgcaagaatcaagagaaatttg

SEQ ID NO: 1612 - DNA, 30 bp, Artificial sequence
  Single strand DNA oligonucleotide
aagatatcctccacttgttgttcaattccc

SEQ ID NO: 1613 - DNA, 32 bp, Artificial sequence
  Single strand DNA oligonucleotide
atgatatcgatctgaacagcagtaagtaagcc

SEQ ID NO: 1614 - DNA, 31 bp, Artificial sequence
  Single strand DNA oligonucleotide
atgatatctaagaagaacaagacatggatcg

SEQ ID NO: 1615 - DNA, 21 bp, Artificial sequence
  Single strand DNA oligonucleotide
cgtgagaactaagaaacaccc

SEQ ID NO: 1616 - DNA, 31 bp, Artificial sequence
  Single strand DNA oligonucleotide
tcccgggacatcttttcaactaaaccaagac

SEQ ID NO: 1617 - DNA, 31 bp, Artificial sequence
  Single strand DNA oligonucleotide
tcccgggctaaaccaagacttacacaagacg

SEQ ID NO: 1618 - DNA, 33 bp, Artificial sequence
  Single strand DNA oligonucleotide
attgtcgacagagttatgggagataatagagga

SEQ ID NO: 1619 - DNA, 31 bp, Artificial sequence
  Single strand DNA oligonucleotide
attctagactcattctgagctttacatgttc

SEQ ID NO: 1620 - DNA, 32 bp, Artificial sequence
  Single strand DNA oligonucleotide
tttctagattggtttacacctcaactcactac

SEQ ID NO: 1621 - DNA, 36 bp, Artificial sequence
  Single strand DNA oligonucleotide
aatgtcgacaacaaatgatccttcaggcagttaaag

SEQ ID NO: 1622 - DNA, 33 bp, Artificial sequence
  Single strand DNA oligonucleotide
tttctagatattaaaacttagattcgggatcag

SEQ ID NO: 1623 - DNA, 30 bp, Artificial sequence
  Single strand DNA oligonucleotide
aactgcaggatcatcacttctcagatttcg

SEQ ID NO: 1624 - DNA, 31 bp, Artificial sequence
  Single strand DNA oligonucleotide
aactgcagaaaaatgaattcagaatcgctag

SEQ ID NO: 1625 - DNA, 30 bp, Artificial sequence; identical to SEQ ID NO: 1623
  Single strand DNA oligonucleotide

SEQ ID NO: 1626 - DNA, 28 bp, Artificial sequence
  Single strand DNA oligonucleotide
tcccgggcaatctgacctcaaaactccc

SEQ ID NO: 1627 - DNA, 30 bp, Artificial sequence
  Single strand DNA oligonucleotide
aactgcaggatcaatgaagattcggaacag

SEQ ID NO: 1628 - DNA, 29 bp, Artificial sequence
  Single strand DNA oligonucleotide
tcccgggtacaacaagaaacctctgattc

SEQ ID NO: 1629 - DNA, 29 bp, Artificial sequence
  Single strand DNA oligonucleotide
tcccgggcctgtgccacagctatacttac

SEQ ID NO: 1630 - DNA, 31 bp, Artificial sequence
  Single strand DNA oligonucleotide
gaagtcgacatccgtagtttcagtttcgtcc

SEQ ID NO: 1631 - DNA, 32 bp, Artificial sequence
  Single strand DNA oligonucleotide
gaagtcgaccttgtctgttccagatgaaattg

SEQ ID NO: 1632 - DNA, 27 bp, Artificial sequence
  Single strand DNA oligonucleotide
tgagctcctctatcgacgtccggattc

SEQ ID NO: 1633 - DNA, 27 bp, Artificial sequence
  Single strand DNA oligonucleotide
tgagctccgtccggattcataaacaac

SEQ ID NO: 1634 - DNA, 29 bp, Artificial sequence
  Single strand DNA oligonucleotide
ggagtcgaccatcgggacacatctttagg

SEQ ID NO: 1635 - DNA, 21 bp, Artificial sequence
  Single strand DNA oligonucleotide
catctttaggctcaaggattc

SEQ ID NO: 1636 - DNA, 30 bp, Artificial sequence
  Single strand DNA oligonucleotide
tgagctcgatcctcgtttattacaagtctg

SEQ ID NO: 1637 - DNA, 31 bp, Artificial sequence
  Single strand DNA oligonucleotide
tcccgggcacaccaagattgattacaaagag

SEQ ID NO: 1638 - DNA, 28 bp, Artificial sequence
  Single strand DNA oligonucleotide
aatgtcgacgattggagataggcaggca

SEQ ID NO: 1639 - DNA, 28 bp, Artificial sequence
  Single strand DNA oligonucleotide
tttctagaggtagccaaagctgacactc

SEQ ID NO: 1640 - DNA, 30 bp, Artificial sequence
  Single strand DNA oligonucleotide
aatctagagaggcatatgcacttcttatcg

SEQ ID NO: 1641 - DNA, 28 bp, Artificial sequence
  Single strand DNA oligonucleotide
aagatatccaggacgggttctcgatcag

SEQ ID NO: 1642 - DNA, 28 bp, Artificial sequence
  Single strand DNA oligonucleotide
aagatatccagcgaacacgtctacgatg

SEQ ID NO: 1643 - DNA, 28 bp, Artificial sequence
  Single strand DNA oligonucleotide
atgatatcgcacgagttcaactcagctg

SEQ ID NO: 1644 - DNA, 31 bp, Artificial sequence
  Single strand DNA oligonucleotide
atgatatcgaactgcttgagatgtaacagct

SEQ ID NO: 1645 - DNA, 22 bp, Artificial sequence
  Single strand DNA oligonucleotide
gactcaacgaacttagcagatg

SEQ ID NO: 1646 - DNA, 20 bp, Artificial sequence
  Single strand DNA oligonucleotide
ctgagaacaactgccacagc

SEQ ID NO: 1647 - DNA, 23 bp, Artificial sequence
  Single strand DNA oligonucleotide
gtgaggtaagacatagcgatgag

SEQ ID NO: 1648 - DNA, 20 bp, Artificial sequence
  Single strand DNA oligonucleotide
cagcagtagagccaacgttc

SEQ ID NO: 1649 - DNA, 23 bp, Artificial sequence
  Single strand DNA oligonucleotide
ctagcagtgttagagagcatgac

SEQ ID NO: 1650 - DNA, 20 bp, Artificial sequence
  Single strand DNA oligonucleotide
tcagccacccaaaccatgac

SEQ ID NO: 1651 - DNA, 277 bp, Artificial sequence
  NOS terminator
gagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattc

SEQ ID NO: 1652 - DNA, 2322 bp, Artificial sequence
  Arabidopsis 6669 promoter
aagctttaagctccaagcccacatctatgcacttcaacatatctttttctagatgagttggtaaaagtagaaaaagatatgatgattttaaatttgtttctatttatatgtgttcatcgaaacttcattttttttagttttaatagagagtttatatgacttttaaaaattgatttaaaactgtgtcaaaaattaaaaggacaataaaaaatttgcatacaaccgaaaatacttatatttagacaagaaaaaataatacttgtgatgctgattttattttattatatatcatgaatcatgatcatccaattttccggataagccaaagtcaaaatgatgggttccccctaatcttttatgctgagaaatagatgtatattcttagatagtaatataaaattgggttaaagaatgatgattcgattatagcctcaactagaagatacgtgtagtgcaggtgtgtagttaactggtggtagtggcagacaaccagattaggagttaaataaagcctttagatttgagagattgaaatattcgattggaacctttctagatttttacagccatctaaaattagatgcagatcacctactaccattcaaaaatgaacaaaataatttcatttacattttcctagcataagatataataataaaatagtgctcattttaattactttttctaaatattttcgttattttaaattttgcttgtctatactctacagctcatttaataacggaaacaaaaataattgcagggatacggatgggtagctttcaaaacttacatcatcttctgtttcttgagatcaactatttttggagctttgtctcaatcgtaccaaaggataatggtcctacctccttttgcattcttaactttatcttctctacttatttcttttttgggatttttgggggtattattttatcttttgtagatatacacattgatttactacaaacgtatactactatccatcttcaactcttcggaatatgatttcgaaaaaactatgaagattaacgggtatcttaaacatgttaagatacaccggacaattttcatttagaagaattgatatgcaattaacaataaatagttgatgatcttttagttttgaagatgtgcgttaagacttaagcgtgtggtaacaaggtgggactcgggcaacgcaaagccttgtagagtccacttgctcaacttgtctttcttttatctcttttccaagtctcaagattcaatgaactccgtgtaacacaaacacgcccatagatgagctcatttttggtatttccaatattgccactccatgataatatcatctagggatggggttcatttattttgaaatctcaacaaatctcgtcgattctaacacacatgattgatttgtttacttacttgaaagttggcaactatctgggattaaaatttatctttttctactgctagctagaagcatctatatatgttagcctaatacgtggaagatgtcattgctaataatggctaaagatgtgtattaatttttcttcttttttccttgaatttttgttctttgacataaactatgctgtcaaaatgtgtagaatctttttacataaatcattccctgttacacactaaaaggttcacaacggacgattgtattggacttccagatcataaaccatgcaaaactgaaaaccacaagaataattagttctaactttagaacgttcgtacgtgtttcatgttcaaaaagcgtcaattataaaagttgggaaattacttttgagttttgacatttctaaggacagtcaaatatgacaacattgggatgcaacttaccttgtattaacttattttgttataaaaccatatattacatattttaaagggttgataaataatcaaatataccaaaacatagcttttcaatatatttgtaaaacacgtttggtctactagctaattatgagaacatttgttcaatgcatgattatctagtatctactagtggattatgaaaattagatattttcattgcatgattatcttccatatatagtgataacatcaaaagaatctacaccaattattgcattttttcattatataataagcactaaactgtaaaattatattcagccacccaaaccatgacaaatcaccttaaaggcttaaacacataacagccattacgagtcacaggtaagggtataatagtaaagaatcaatctatataatatacgacccaccctttctcattctttctggagagtaacatcgagacaaagaagaaaaactaaaaaagagaaccccaaaggatcc

SEQ ID NO: 1653 - DNA, 4716 bp, Solanum lycopersicum
ctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgcggccgctattgataagcttgtcgacgattggagataggcaggcattttttattggaggagatgttaagttattagcgtaatttatataaaaatgaaggtcttaattgtaaacaaagtttgtatataaggtagctcaaagtttttgagggaagcaaataatggattgtctagtagtagttttgctactttttacacttgtgacttgttcagtatgtgagaccttctttgaagaacgatttgatgatggttggcggaacaaatgggtgaagtctgagtggaaaagcagtgaaggaaaagcagggaaatttaagcacacagcgggcaactggcctggtgatcctgatgacagaggtcttcagacaacaagtgatgccaaacattttgccctctctgcaaagataccggaatttagcaataaaaacacaacactggttgtacagtattctattaagtttgagcaagatattgaatgtggaggaggctacataaagcttctctctggatatgtcaatcagaagaaattcggaggagacaccccatacagttttatgtttggaccagatatatgtggtacacagacaaagaaacttcatgttatactttcctaccaaggacagaattaccccatcaagaaggaattagaatgtgaaacggacaaattaacacatttctacaccttcattcttagacctgatgcatcatacagcatctggattgatggtagagaaagagattctggaagtatgtacacagattgggacatacttcctccccgcaaaattaaggctgtaaatgcgaaaaagcctactgactgggatgatagggaatatatagaggatccaaatgatgtcaaacctgagggatatgattctattccaagagagatttcggacccaaaagctaaaaagcctatttactgggatgacgaagatgatggtatgtggaaggcacccaaagtacctaatccagcataccggccgggtgcatggaaaaggaagaaaattaagaaccccaattataaagggaaatggaagatcccctggattgataatccagaatttgaagatgatcctgatctctacgtgctgaagccaatcaaatatgtcggtattgaagtttggcaggtaaaggcaggttctatttttgataacattctgattggcgatgatccagattatgcaaaacaagtgattcaggaagtgttttcccatagggaggctgaaaaggaggctttcgaagaggcagagaaagtgagaaaagcaaaagaggaagaggaagctcaaagatcaagagaggaaggtgaacggaggagacgagaaaggggtagggacagacaccgggacagatacaagaggcgctaccaccatgattatatgtatgacgatcatgatgaactttaatttggtgttaagaccatatactacatttccagcatggacgcacatacatttggggtttattgtgttcctcttgttgtattttgatcttattgtagctgtaattttgcaaaatgctcaggcgtccgataagaagtgcatatgcctctctagaatacgagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcaatgcggccgccaccgcggtggccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 1654 - DNA, 1520 bp, Artificial sequence
  Cloned MAB66
gattggagataggcaggcattttttattggaggagatgttaagttattagcgtaatttatataaaaatgaaggtcttaattgtaaacaaagtttgtatataaggtagctcaaagtttttgagggaagcaaataatggattgtctagtagtagttttgctactttttacacttgtgacttgttcagtatgtgagaccttctttgaagaacgatttgatgatggttggcggaacaaatgggtgaagtctgagtggaaaagcagtgaaggaaaagcagggaaatttaagcacacagcgggcaactggcctggtgatcctgatgacagaggtcttcagacaacaagtgatgccaaacattttgccctctctgcaaagataccggaatttagcaataaaaacacaacactggttgtacagtattctattaagtttgagcaagatattgaatgtggaggaggctacataaagcttctctctggatatgtcaatcagaagaaattcggaggagacaccccatacagttttatgtttggaccagatatatgtggtacacagacaaagaaacttcatgttatactttcctaccaaggacagaattaccccatcaagaaggaattagaatgtgaaacggacaaattaacacatttctacaccttcattcttagacctgatgcatcatacagcatctggattgatggtagagaaagagattctggaagtatgtacacagattgggacatacttcctccccgcaaaattaaggctgtaaatgcgaaaaagcctactgactgggatgatagggaatatatagaggatccaaatgatgtcaaacctgagggatatgattctattccaagagagatttcggacccaaaagctaaaaagcctatttactgggatgacgaagatgatggtatgtggaaggcacccaaagtacctaatccagcataccggccgggtgcatggaaaaggaagaaaattaagaaccccaattataaagggaaatggaagatcccctggattgataatccagaatttgaagatgatcctgatctctacgtgctgaagccaatcaaatatgtcggtattgaagtttggcaggtaaaggcaggttctatttttgataacattctgattggcgatgatccagattatgcaaaacaagtgattcaggaagtgttttcccatagggaggctgaaaaggaggctttcgaagaggcagagaaagtgagaaaagcaaaagaggaagaggaagctcaaagatcaagagaggaaggtgaacggaggagacgagaaaggggtagggacagacaccgggacagatacaagaggcgctaccaccatgattatatgtatgacgatcatgatgaactttaatttggtgttaagaccatatactacatttccagcatggacgcacatacatttggggtttattgtgttcctcttgttgtattttgatcttattgtagctgtaattttgcaaaatgctcaggcgtccgataagaagtgcatatgcctc

SEQ ID NO: 1655 - protein, 413 aa, Solanum lycopersicum
MDCLVVVLLLFTLVTCSVCETFFEERFDDGWRNKWVKSEWKSSEGKAGKFKHTAGNWPGDPDDRGLQTTSDAKHFALSAKIPEFSNKNTTLVVQYSIKFEQDIECGGGYIKLLSGYVNQKKFGGDTPYSFMFGPDICGTQTKKLHVILSYQGQNYPIKKELECETDKLTHFYTFILRPDASYSIWIDGRERDSGSMYTDWDILPPRKIKAVNAKKPTDWDDREYIEDPNDVKPEGYDSIPREISDPKAKKPIYWDDEDDGMWKAPKVPNPAYRPGAWKRKKIKNPNYKGKWKIPWIDNPEFEDDPDLYVLKPIKYVGIEVWQVKAGSIFDNILIGDDPDYAKQVIQEVFSHREAEKEAFEEAEKVRKAKEEEEAQRSREEGERRRRERGRDRHRDRYKRRYHHDYMYDDHDEL

SEQ ID NO: 1656 - DNA, 1595 bp, Solanum lycopersicum; identical to SEQ ID NO: 904

SEQ ID NO: 1657 - DNA, 1667 bp, Solanum tuberosum; identical to SEQ ID NO: 694

SEQ ID NO: 1658 - DNA, 1514 bp, Piper betle
caataatgaaaaggggaaaagtctacttcaagtcctctcttcagttgaatcaatgctattagctttcttgattttttcacttatcacatcttcattatctgagatcttctttgaagaaagatttgatgatgattggcagagcagatgggtgaggtctgactggaaaaggagtgaagggaaagcaggctcctttaggcatacagctgggaaatggtctggtgaccctgacgataaaggtattcagacgacaaccgatgccagacatttcgccatctctgctaagataccagaatttagtaacaagaacagaacattggttgtacagtactctattaagtttgagcaggacattgagtgtggtggaggttacctaaagcttcactctggatatgtcaaccagaagaaatatggtggagataccccttacagcatgatgtttggaccggatctctgtggtacacagacgaagaaacttcatgttatactttcctaccaaggccagaattatccgatcaaaaaggatctacaatgtgaaacagataaattaacccatttctacacgttcattcttagacctgatgcatcatacagcgtctggatagatggccgagaaagggattctggaagcatgtatacagactgggatatccttcctcctcggaaaattaaagatttgaatgcgaaaaagcctgcagattgggaagaaagagaatatatagacgatccaaaccaggtcaaaccggagggatatgactctattccgcgagagatccctgacccaaaagctaaaaagcctgatcactgggatgaagaagaagatggcatctggagaccaccaaaagttcctaatccagcatataaaggtccatggaaacgaaagaaagtaaaaaaccccaactacaaaggtaaatggaagaccccttggatcgacaatccagaatttgaagatgatcctgatctctatgtactgaggcctaccaaatatgtcggaatcgaaatttggcaggtgaaggcaggttctgtatttgacaacatactgatatgcgatgatccagattacgcaaagaaagtgattgaggaagtctttgttcatagggaggctgaaaaagaggcttttgaggaagcggagaaagtgagaaaagcaagagaggaagaggaatcccaacgagcaagagaagaaggtgaaaagaggagaagagacagggacagggacagacatagagacagacacaggaggcgctatcgtcacgattacgatggtgactatcatgatgaactttgatttggtgttgaaaaggcaaaaaacactacattttccactcttttgagacagaaaattagctctactcatttgggctttgtgtgttgctgttgttgtattttactctttaaacagtaactttattattgttgcatagtgcaatgtgttaggctcaaaacaagacagattgttctattttcatcttattgtctctactgcttttttttccaatgcaaacatggctagcggccgc

SEQ ID NO: 1659 - DNA, 1493 bp, Triphysaria versicolor; identical to SEQ ID NO: 912

SEQ ID NO: 1660 - protein, 436 aa, Solanum lycopersicum; identical to SEQ ID NO: 1473

SEQ ID NO: 1661 - protein, 432 aa, Solanum tuberosum; identical to SEQ ID NO: 1263

SEQ ID NO: 1662 - protein, 426 aa, Piper betle
NNEKGKSLLQVLSSVESMLLAFLIFSLITSSLSEIFFEERFDDDWQSRWVRSDWKRSEGKAGSFRHTAGKWSGDPDDKGIQTTTDARHFAISAKIPEFSNKNRTLVVQYSIKFEQDIECGGGYLKLHSGYVNQKKYGGDTPYSMMFGPDLCGTQTKKLHVILSYQGQNYPIKKDLQCETDKLTHFYTFILRPDASYSVWIDGRERDSGSMYTDWDILPPRKIKDLNAKKPADWEEREYIDDPNQVKPEGYDSIPREIPDPKAKKPDHWDEEEDGIWRPPKVPNPAYKGPWKRKKVKNPNYKGKWKTPWIDNPEFEDDPDLYVLRPTKYVGIEIWQVKAGSVFDNILICDDPDYAKKVIEEVFVHREAEKEAFEEAEKVRKAREEEESQRAREEGEKRRRDRDRDRHRDRHRRRYRHDYDGDYHDEL

SEQ ID NO: 1663 - protein, 428 aa, Triphysaria versicolor; identical to SEQ ID NO: 1481
  misc_feature (9)..(11): Xaa can be any naturally occurring amino acid
  misc_feature (20)..(20): Xaa can be any naturally occurring amino acid

SEQ ID NO: 1664 - DNA, 2001 bp, Artificial sequence
  GUS intron
atgttacgtcctgtagaaaccccaacccgtgaaatcaaaaaactcgacggcctgtgggcattcagtctggatcgcgaaaactgtggaattggtcagcgttggtgggaaagcgcgttacaagaaagccgggcaattgctgtgccaggcagttttaacgatcagttcgccgatgcagatattcgtaattatgcgggcaacgtctggtatcagcgcgaagtctttataccgaaaggttgggcaggccagcgtatcgtgctgcgtttcgatgcggtcactcattacggcaaagtgtgggtcaataatcaggaagtgatggagcatcagggcggctatacgccatttgaagccgatgtcacgccgtatgttattgccgggaaaagtgtacgtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaatttgttgatgtgcaggtatcaccgtttgtgtgaacaacgaactgaactggcagactatcccgccgggaatggtgattaccgacgaaaacggcaagaaaaagcagtcttacttccatgatttctttaactatgccggaatccatcgcagcgtaatgctctacaccacgccgaacacctgggtggacgatatcaccgtggtgacgcatgtcgcgcaagactgtaaccacgcgtctgttgactggcaggtggtggccaatggtgatgtcagcgttgaactgcgtgatgcggatcaacaggtggttgcaactggacaaggcactagcgggactttgcaagtggtgaatccgcacctctggcaaccgggtgaaggttatctctatgaactgtgcgtcacagccaaaagccagacagagtgtgatatctacccgcttcgcgtcggcatccggtcagtggcagtgaagggcgaacagttcctgattaaccacaaaccgttctactttactggctttggtcgtcatgaagatgcggacttgcgtggcaaaggattcgataacgtgctgatggtgcacgaccacgcattaatggactggattggggccaactcctaccgtacctcgcattacccttacgctgaagagatgctcgactgggcagatgaacatggcatcgtggtgattgatgaaactgctgctgtcggctttaacctctctttaggcattggtttcgaagcgggcaacaagccgaaagaactgtacagcgaagaggcagtcaacggggaaactcagcaagcgcacttacaggcgattaaagagctgatagcgcgtgacaaaaaccacccaagcgtggtgatgtggagtattgccaacgaaccggatacccgtccgcaaggtgcacgggaatatttcgcgccactggcggaagcaacgcgtaaactcgacccgacgcgtccgatcacctgcgtcaatgtaatgttctgcgacgctcacaccgataccatcagcgatctctttgatgtgctgtgcctgaaccgttattacggatggtatgtccaaagcggcgatttggaaacggcagagaaggtactggaaaaagaacttctggcctggcaggagaaactgcatcagccgattatcatcaccgaatacggcgtggatacgttagccgggctgcactcaatgtacaccgacatgtggagtgaagagtatcagtgtgcatggctggatatgtatcaccgcgtctttgatcgcgtcagcgccgtcgtcggtgaacaggtatggaatttcgccgattttgcgacctcgcaaggcatattgcgcgttggcggtaacaagaaagggatcttcactcgcgaccgcaaaccgaagtcggcggcttttctgctgcaaaaacgctggactggcatgaacttcggtgaaaaaccgcagcagggaggcaaacaatga

SEQ ID NO: 1665 - DNA, 922 bp, Artificial sequence
  Cloned MAB134
cgacacccttctcctcctccccgcacacccatggggtcgtcggaggccgacgacgaccagctcctcaagagtttcttggccgaggtcagcgaggccgagcgcgacaacgaagtcctcaggatactcggttgcttcaagttaaacccttttgagcatcttaagttgtcttttgattcttctgttgatgaggtgaagaagcaatataggaagttgtcactgttggtccatcctgacaagtgcaagcatccacaagcacaggaagcttttggagccctggcaaaagcacagcaactcctactcgatccacaggaaagagggtacattctggatcaagttacttctgcaaaagaagaactgagggcaaaaaggaaaaaagagctgaggaaagacagcgcatccaagataaaatcccaagtagatgagggaaagtacgaagagcagtttgaaagatcagacgaatttcagaagcagctaataattaaagttcgtgagattttgacggacaaagaatggcgtcggaggaaaatgcagatgaggatatcagaggaagaaggaagactgaagaaggacgaggaggaaacaaaagaaatgtggaagaggaagagagagcatgaagagaagtgggaggagaccagagaccagcgagtctctagctggagggatttcatgaagacaggaaagaaggcacggaaaggagagctcaaacctccgaggctcaagaccgaagacccgaacaaatcttatgttcagaggccagtaaagcgtggttaaaaggaatcgtattcatctgcactcgaagaccaatctgtcggccattcttgccgcgacctgatccaagccacagcctgtcaagttaatctttcaggctataagcttgggttatgacttgtatgttcccagtgtagtcagtggaacatagcag

SEQ ID NO: 1666 - DNA, 2684 bp, Artificial sequence
  Cloned MAB146
agagttatgggagataatagaggattaggtgtttttggagtatcaatgtgtggtgcagcacaagaaatagaacaattatcaagagaaagtagtcattatagtctttctactggaattttaccttcacttggtgcaagaagtaatagaagagttaagcttaaaagatttattatttcaccttatgatcgacaatacaggttatgggagacatttctagttgtgctggttgtttacactgcttgggtgtccccgttcgagtttggctttctaggaaaaccagcagggccacttgctaagacggacaatgtagtcaatggattcttcgcgattgatatcattcttaccttcttcgtagctttcttggatagaaccacttatctacttgtcgatgaacataaaaagattgcttggaagtatatgagtacttggttcttattcgatgtcatatcaacaatcccttcagaacttgctgtgaagatttctccaaaacctttacgtcagtatggattattcaatatgcttcgtttgtggcgtctaagaagagttagtgcattgtttgcaagattggagaaagataggaacttcaattacttttgggttcgatgtgcaaagcttgtttgtgtcactctttttgctgttcattgtgccggatgcttttattatcttatcgcggttcattatcctgatccaaagaggacatggatcggagttgctatggatgacttccttaatcagagcttatggattcgttatgtcacttctatttattggtcgataactactctcactacagtcggttatggagatctgcatccagagaatacgcgggaaatgatctttgatattttctacatgctctttaacttgggattgacagcatacttaataggaaatatgactaacttggttgtgcacgggacgagtaggactagaaaatttagagatacaattcaagctgcttcgagctttgcacagaggaaccaattgcctgctcgactccaagatcagatgcttgcacacttgtgcttgaagttcagaacagactcggaagggctgcagcagcaagagacactcgagtctcttcctaaagctatccgttcaagcgtttcacattttcttttctactctttagtagataaggtttacctgtttcgtggagtgtcaaatgatctactcttccagctggtctccgagatgaaggcagagtactttcctcccaaagaggatgtcattttgcagaatgaagcaccaaccgacttctatattcttgtaacaggagctgtggatctagtagtgcttaaaaacggagttgaacaggttgttggggaggtcagggctggtgatctttgtggtgaaatcggggttctttgttataggcctcaactatttacagtacgaacgaagagactgtgccagctactacgtatgaatcgtaccacatttctgaatatcgtccaggccaatgttggggacgggacaataatcatgaataatctacttcagcatttgaaggaaatgaagaatccaattatggagggtgttctacttgagaccgagcatatgttagctcgcggtagaatggacttgcctctcaccctttgctttgcaacacttagaagtgatgacttattgttgcatcacttgttaaagcgcggtcttgatccaaatgaatcagataacaatggaagatccgcgttgcatatcgctgcgtctaaaggcattgagaactgtgtggttcttctgctcgatttcggggctgatcccaatagtagagattcagaaggcaatgtgccattgtgggaggctatcatggggaagcatgaatcagttatccagttactcgttgacaacggtgctaaactatcagctggtgatgtgggacatttcgcctgcgttgctgttgaacaaaacaacttgagtttgctcaaggagattgtccgttatggcggggatgtcacgcttcccaagatcaacggttcatcagctctccatgtagctgtctgtgaaggtaacatagaaatagtaaagtacctcttggatcgaggggctaacgttgatcaaccagacgaacataattggacccctcgggaccttgctgagcaacaaggacatgaagacatcaaagaactcttcgaatccagagtaatgatgagaactcgatccgttgatcctatcccagaggaacgaggggttcgatttcttggtaggttcaaaagtgagccaacaatctcccctgcatcacatggagtctcatttctaggactagatggatcattaggacgatcacgtcctagacgcaggtctaataacttccacaactcattattcgggataatgtcagcaaagcagaccaatgcaagcgacgtgcttttatctgcaaacgacactaatgtaagtagcacgacaaccaagacttatgctcctcgagtgatcgtgtgttgccctgagaaaggagacaatgggggaaaactcattttactcccacagagttttaaagagctacttcaaattggttctagtagatatggtatctctcaggccaaagttgttagcaaagatggagctgaaatcgatgaaatcgagttgatcagagatggtgatcgtttagtttttgttagagataaagaaaacaatatcgatgaagctaaatcatcataattgtagtgagttgaggtgtaaaccaa

SEQ ID NO: 1667 - DNA, 1068 bp, Artificial sequence
  Cloned MAB15, codon optimized for expression in Maize
tctagaaaggatccaacaatggccacagcagctgcggccaccgccgcctccacctccctgctcgcgccggcggcgagcagcacggcgccgggggcctcgcccaacgcgctgttcttcccctcctccgtgccgtcgctgcgcgcctacccgcggctcctcctcgcgttccgccgccccgccgccgcggccgcccagggcgccgtgctcgaagaggaggaggtacaggccgaccagcggggccagtacgacgacgacgacgacgggtacgagggcgggcgcggccccgcgttcacggcccccacgcggccgcgcaccggcaaggccgcactaccgctcaagcgcgaccgcacgaggtccaagaggttcctcgagatacagaagctgagggagagcaagaaggactacgacgtgcccaccgccatctcgctgatgaagcagatgtccagcgccaagtttgtcgagtcggcggaggcgcacttccgcatgaacctcgaccccaagtacaatgaccagcagctccgggccacggtgaatttgcccaagggaacaggccagtcggtgaagattgcggttctcacacaaggtgagaagatagatgaagctagagctgcaggagcagatatcgtaggtggagaagatttgattgaacaaataaaaggaggatttatggagtttgacaaattgattgcatcacctgatatgatgcctaaggttgccggcttgggtaagattctaggaccaagagggctgatgcctaaccccaaagctggcactgtttctccaaacattactcaggctatcgaagagttcaagaaagggaaggttgaatacagagttgataaatcaggaattgtccatattccctttggcaaggttgactttccggaggaagatctcattgcaaacttcatggccgttgttcgctctgttgagaggaacaagccatctggtgctaaggggatatactggaaaacagcgtacttgtgctcatccatgggaccttctatcaagctaaacataaaagaaatgcttgattatggtttggactcatctgactagtgaggtacc

SEQ ID NO: 1668 - DNA, 381 bp, Artificial sequence
  Cloned MAB3
tctagaaaggatccaacaatgagggcgggcaggttggtgatcctcgtggcggtggcggtggtggtggtggtcgccggcggcggggcggcggagggcgccggcgagtgcgggagggcgtccgccgaccgggtggcgctgcggctggcgccgtgcgtgtcggcggcggacgacccgcagtcggcgccgtcgagcagctgctgctcggcggtgcacaccatcgggcagagccccagctgcctgtgcgccgtgatgctgtccaacacggccagggtcgccgggatcaagccggaggtcgccatcaccatccccaagcgctgcaacatggccgaccgccccgtcggctacaagtgcggagattacacgctgccttgatgaggtacc

What is claimed is:

1. A method of increasing abiotic stress tolerance, nitrogen use efficiency, biomass, growth rate, and/or yield of a transformed plant as compared to a wild type plant of the same species which is grown under the same growth conditions, the method comprising:
   (a) expressing within the plant an exogenous polynucleotide encoding a polypeptide comprising an amino acid sequence at least 96% homologous to the amino acid sequence set forth in SEQ ID NO:219, and
   (b) selecting a plant having an increased abiotic stress tolerance, nitrogen use efficiency, biomass, growth rate, and/or yield, wherein said abiotic stress is selected from the group consisting of salinity stress and nutrient deficiency,
   thereby increasing the abiotic stress tolerance, nitrogen use efficiency, biomass, growth rate, and/or yield of the transformed plant as compared to the wild type plant of the same species which is grown under the same growth conditions.

2. The method of claim 1, wherein said polypeptide is as set forth in SEQ ID NO:219.

3. The method of claim 1, further comprising growing the plant expressing said exogenous polynucleotide under the abiotic stress.

4. The method of claim 1, wherein said amino acid sequence is at least 97% identical to the amino acid sequence set forth in SEQ ID NO:219.

5. The method of claim 1, wherein said amino acid is at least 99% identical to the amino acid sequence set forth in SEQ ID NO:219.

6. The method of claim 1, wherein said exogenous polynucleotide is at least 95% identical to the polynucleotide set forth in SEQ ID NO:1538.

7. The method of claim 1, wherein said exogenous polynucleotide is set forth in SEQ ID NO:1538.

8. The method of claim 1, wherein said nutrient deficiency comprises nitrogen deficiency.

9. A method of selecting a plant having increased abiotic stress tolerance, nitrogen use efficiency, biomass, growth rate, and/or yield of a transformed plant as compared to a wild type plant of the same species which is grown under the same growth conditions, the method comprising:
   (a) providing plants transformed with an exogenous polynucleotide encoding a polypeptide comprising an amino acid sequence at least 96% homologous to the amino acid sequence set forth in SEQ ID NO:219,
   (b) selecting from said plants a plant having increased abiotic stress tolerance, wherein said abiotic stress is selected from the group consisting of salinity stress and nutrient deficiency,
   thereby selecting the plant having increased abiotic stress tolerance, nitrogen use efficiency, biomass, growth rate, and/or yield as compared to the wild type plant of the same species which is grown under the same growth conditions.

10. The method of claim 9, further comprising:
    (c) growing a crop of said plant transformed with said exogenous polynucleotide.

11. The method of claim 10, wherein said growing comprises seeding seeds and/or planting plantlets of said plant transformed with said exogenous polynucleotide.

12. The method of claim 9, wherein said nutrient deficiency comprises nitrogen deficiency.

13. The method of claim 9, wherein said amino acid sequence is at least 97% identical to the amino acid sequence set forth in SEQ ID NO:219.

14. The method of claim 9, wherein said amino acid is at least 99% identical to the amino acid sequence set forth in SEQ ID NO:219.

15. The method of claim 9, wherein said exogenous polynucleotide is at least 95% identical to the polynucleotide set forth in SEQ ID NO:1538.

16. The method of claim 9, wherein said exogenous polynucleotide is set forth in SEQ ID NO:1538.

17. The method of claim 10, wherein said growing is effected under the abiotic stress.

* * * * *